United States Patent 11,969,446 (COMPOSITIONS COMPRISING BACTERIAL SPECIES AND METHODS RELATED THERETO) - sequence listing, part 2

SEQ ID NO: 21 - DNA, 32651 bp, Christensenella sp.
ttatataattatatagacaaacaaacgcccgtttattaaaacgggcgtttgtttgtctgcttaacatcagcgttttccataagtgagagttgtttcgaacattgcctcgatattttcggtctttgcatcatcgatcatggttccgctgtccatgatatatccaccgcccggcgcgcatgtgtcgataagccatttgcagtaatccacgacttcctgcttgctgccatagctcagcgttacggcggggacgttgcccatgatgcaggaatggccgcccagcacttttttggcttgctccatatccgtatattcaaaggagaagatcgccttgcccggcgtgatctctttcagatagtcaaggcgcgtattgtaggcgccttccacataaacgacaggggtcagtccggcatccgcaacggcattgatatatttgcgcagagacggccagtagaaggttttgaattgctcgtcggacatgaattcgtccacgcctttatgcagccagtaccatacgaagggggtatccttaccgctgcagcccttgatggtatcttcgatcgcaaaatccgttaccacgtcgatgagttctaaaagctcctgcggatggtcgaacatatccatgaggatcggtaccgtaccgcgcatggaatcgccgatcatatcaaagggcgcataggcaaagcccgcgtaaatgagcgggatcccaaatttatttttgagcttttgcccatattcgctgagataagcaaaccactcgtttaaaatcttgcccgtttccaccattgcctccagcgtgcggatcacttccggatcggaaaaattaagcagggtaccgatgtgtccgaaccacatggcgttccggaaatcaagctttgaaagcccggaaaagtttgcaaagctgcggggcatccatttgttcatcatgaatttggtcatgtcgcggatcgcctcggggtattcttcggcggtcatgtattcgccttcggcgtattggtacatggcgttggggtcatcgatatcatggcccggccagcggtaccatgtgatgcccgaacgctcaaggtatgcagacggattgaacaggatcgggtcccaaccgaggtccggctggaaatgctcgtagaaaatgtcgtaggcagcgcctgtattgtgccagtcgtccatcgcatcctgtattgtataaccggcatagtaaatgggaaaggcctggaaaacaggcacgataggaatacggtcaggttcttttattgataccgcgtccattactcttttgagtctggcattatattcttcgtttgtagtcatgagggatccctccggaatttgatacctgtattatagcacgaaagaaaagacaggcatatgattcccatatgcctgcccggataatttttctgttacagggaaagccatttttcctgttttgcagattctacgatagcttcgcacaactggagctcgcgcaggcctgcctcgaaggtcggaaattcgggcgtcgcgcctgtcttataaccctccgtgcggatgtagttatagaacttggtggcgaactgcttgatcgtgtcagggaagccttcgttgtggccgcccggataggagatcagttgcgccgcttcgcggtgcatgagcgaaggatccttcatgagaatatggttcgcttcgtcgcgttcgccgatccacatttcgttggggcgttccgtattgatggcgatggattttttgctgccgtagacttcgaaccaaatacggtttttgcggcctgccgctacctggttgaccgtcatggagccgtgcgcaccgttgttaaatttcaggagcacggaggcataatcttccgtgttgatcggcacgtccgcgtaatcttccggtgtgagtactttgccggaatacgtttccaccggtttaagcggtttcttgcggatcggatagaatgttgcgaagtccgcgcatactttatcaattttgatgccggtcatgaattccacggaatccagccagtgcgaaccgatgtccgcaaccgcgcgggagtcgccgctgaatttaggctcgagacgccagctatagtctgtttccttaaacagccagtcctgctggtaagaaccgtttaccgcaaagatcgttccaagctcgccgttttcgatcatcgcgcgtgcctcgtggatgatagggtagaaacgaatattgaaatgtaccgcgttcgcaagtcccttttcttttgcgagggcaatcaattcctttgcctgctcgctgttcatcgtaagcggtttttcacatacgacatgcttgcccgcgagcagcgcttcctttgccatctggaaatgaaagctgttgggagagcagatatgcacgacgtcgatgtcgggatcggccaaaagatctttataatcaccgtagcttttgccgatcgaaagctgctccgctttcgcctttgccgttgcatcatcgatatcggcaagcgcaacaacgtctacgaaccccagcctgcgcagggcttcaatatgtgtaggcccgataaaacctgttccaataacaccagttctgattttttccataatattgattcctttctaaatctatttccaatttttaagaaaatccgcaagctccgccgttttggggcttttggcgttgcggacataatagcccgacgcgcctacgccgcacaaaaggcactgctcatacggatatccgttcatccatccgagcacaaagccggaattgaacgtatcgcctgcgcccgttgtaaggacagggtgctcgcaatacggacctgatacctcgtaatattttccatccgcaaagcagcatgcacggtcgacagggtggatgacgagacattctatctttaagcactgcgccaggtttttgcatagctgctcgagcggataagacttatagtcgctgatggtttcgccgtatagttcggcaatctcgcatgcttcctttttgttaaggcccagcgtaacggggaaacctttttcagcaaactcgttgatcagcccgatggcttccttgatatcctgcgcgctgcgcttttccggatcggcaagatcgaagaacatttttttatccccggagcaggactttaagcgcggaaagacttccgcaaggaaatgccgccagatatcgctcatgcgcggaagcatcgtccagttttccataccgatgaggtcgctttcgtctacaatgttaatgaatttctcaaggccgactacttccttgattttttcccatgagacatttttgaaatgctccagcttggaaacgatgatcttaccgtcatgaaactcgtatgcgtccgtatggccgggctccgtaaggccgatcattgtggaaccgtctgccagttcgtcaaaaacgggatcatgcccatgctcgccgatgcagccgatataggtcaggctgatattatgtttttttagggcattggcaaaaataggcccgttcccgcccagttttttctggacagggatgatttctatattggtcgaaagaccgcagccattctttaagcgctcggaatacgagaggatcgtatcgacacgggaaaagttttcaggatcgatacgcttatctacgacatgcacgatctcatcgacaaacccatcaaaaccaatgagcgctttttgcggggcaacaccggaagctaatttttgtgcaagtgctttttttacgtcgttcatgctatgctcctagataaagtttttcatgtacctctgcgaaagctcgatagaatggagcttatcttccagtgtatcctcaaacgcacggtcttctacttcgatgacggcatgccctttgtaatggatgtcataaagcgcggagatcgtctttccccagtcgatgtcgccaaggcccggcagtttgggggcgtggtactcgaggggagtagccatcataccgactttgttgtaacggtcaggatagaattttacatccttgatatggaaatggaaaatcttatctgcaaaatcataaatcggctggatgtagtccatctgcggccatacgagatgggacggatcgtagttcaggccaaaatatttgctgtcaatgatggagaacatatccgtccagatcgcaggcgtggaagcgagatttttaccgcccggccattcgtccatggaatagaacattgcgcaattctcgataccgactttaacgtcgttgtcttccgcgcatttgatgatgtccggccagatttccttgaactgcttcatgttttcagagataggaagggacgggtcttttccgataaaggtattcatgttatggaggccgagcatacgcgcgccctcgatacactttttgatgtggtctgcagatgttttacggacagccggatcgggatcaaggggattcggataatagccgatcgcggaaatctccacatttttttctttcaggtaatgattgatgtgttccgcttttgcctgatcaagcgaagcgacgtcgatatgcgtaacgcctgcgtagcgtctttccgccttgccgaccggccaggcagccacttcaacacagtccattttgatcttacttgcatagtcgatcagttgctcgaaagagtattccggcaggatagcgcttacaaatccaagtttcatatttagatcctccttaaaatattagtttattcgataatttaaaaattttattccaaggttttgcggtatggcgttacttcgtatgccgtttgtatgatttatatgatttgtattatttgtatcataataaatgtttggcataattgcaatagttttttgcaaaaacctgaaataattcgttctaccttactattatatataaaccaaatagaaaaacaaagcgattctcatcaaaagaaatatcaaatcaagaagagaatattaattccgtaaaaaagtaaaaaatatacttgcaatttgaaaatagtgatgatacaatacaaacaaatagaacaaatgatacaaatgatacaaataagacataaattacaaatattacaagcggcgaaatatctttgaaacaactatcgaacgaataacaacggggcgaatttgaaggcccgacccagtaggggcaagcagttttgtgcattgttaaagaattcatataattaaaaaaatttatattatcaggaggaaagatcatgaaacctacaaaaaaagcaagtgaaatgtcggtaaaagaactggcggcatatatcgaccagtcggtattaaagcccgagtttacacaggacgatatccgtaagtacatccaggaagggatcgattttggatgcgcgacggtatgtatcaacccggcatcgctcgatatcgcggctgagctcacaaaaggcacggatacaaagatttgcgtggtatgtgatttcccgtttggcctttccacaactgcttccaaggtgctgcaggcagaggaatactgcaagagaggcgacatttatgaattggatatcgttgcaaactatggatggatccgcagcggtatgtataaggaagtagaagaagatatcaaagcggtatgcgacgtatgccataagtatggtacggcggttaaagtaatcatcgaaacagattccttgacgatggacgaaatcaaggaaggcacgaaagccgctgtccgcgcaggcgcagatttcatcaagagttccacaggtttcttcacgggcggtaagagcgacggcgcaaccgtggaagtggtacaggcgatgatggacgcaggcgaaggaaagatcaaagtgaagggttccggcgggatccgtacgagagagcatttcttaaagctgatcgacatgggaatcgaccgcatgggcgttggttaccgttcgactcctgaggtgcttggcactacgatagaagaagtcagaaagcagaaataactttttcataattcctgtcatatggcatatgcattgtgcatatgccatatgacaaaagtattagtctattggccccaccaaactctcagtaaaaaatttttaacggtttattttagaaacaaaatttaatcacagtctcattatttttaagcggaggtaaaaaacatggcttttgaacacattttccaaccaatcaaaatcaaaaatatggttgtgccgaacagggttgttcacgtaccgacagatatcagctcggctgatcccgacggtggtatcaacgatcgtgttatccggtatcatgaagaaatcgcgaaaggcggcacaggccttattatcgtcggtgcttccacgccgaacaggcatacgggacgtcctacggtaacctgtatttctgcagatgaggattattatatcccgggcctgcatatgcttgcaaaggctatgcagaaacacggcgcgaaatgtgcgatccagatccagcatccaggccgccaggcggcatatccaagaaaagggcagatttcctgctcggatatggtttcatacctgccgggcagcgcggggcacgaggttgtgtatgcaggcgggcaggcgcacggtaagatcgctcgtgaaatgacggtcgaggaagtatacgatttggctgagcgttttgcagaagctgcatggcgcgttaaagaagcaggcttcgattgcgtagagctgcatgctgcgcacggctacatgatcgcacagtttatgagtcctgcaacaaatacaagaaacgaccgtttcggcgggaaatatgagaaccgcatgcgtttcattctggagatcattgacaggatcaaacaaaagtgtggcgaagacttccctattctggtaagatattccggtgaagagtggaaacatgacggccggaaactggatgaatccatcaagattgcaaagacgctggaagaagccggcgttgctgcacttgatatttcggcaggtatctttgaccttgcggaaacagttatggacccgatgtattatacggaagggtggaacacatattctgcagaagcgatcaaaaaagcagtcaatatccctgtcatcaccagccatacactgcgcagtccggaatactgcgaccagatcattgcagaaggcaagacggacatggtcggcttttcgcgccagatgcttgcggacccgtattgggcaaacaaagcaaaatccggtgacgttgacagcatccgcaagtgtatcagttgtctcgtaggctgctggtccgaatccctgatgatcaaacacgagatgcgctgtgcggtcaatccggcgatcggcgatacacgcttcctcgatatgaaaccggcgggcacgagcctgaaggtcggcattgtcggcggcggtattgcaggtatggaagcggcgcgcattgcgaagctccgtgggcatgacgtaacgctgtacgaaaaagacagcgaactcggcggtattctccgtacatgctgtatggttccgccgaaaggtaaaatgaagtggtacatggattggatgcgccgccagatgaaagaactggatattaatatccagctgaatacggaagcaaccgtagatatgctcaaaggctatgacgttgtactgtgcggcacgggcagcaatccggttatcccggatatcccgggcaaggaaaagggcgttaagttcgaggacattctggtgtgcgtgaagaaaaactgcgagtactggccggaatgcggcaaacgcgaacctgccaaggttggacagaaggtcgttgtttacggaaaccattacggtgcgacggatacggcggaggcgcttgcgctgcgtggtaaggaagttatttatgtaacgcaggacgcagagtttgcaccgcacatcgagaacgtgcataaggaagtattgaaagtacgttttgcaggcggcaacggcggcggacttccggaagaacatccgatcaagattccggtagacgtaaaactttcaacgacgcttctggaagtaaaagacggaagcgtggtactgatggacagcaagttcaacaagtatgaagtagaatgcgacacagtcgtattcggcgaatatgcatccaatacgaagttgtatgacgaattggttgctgcgggcgtactcgtagggaatatcggcgactccagaatgatccgcaacgtacgcggcgcaatgacggatggtgcgaacgcaggattgatgctggacgctggcctgttcatgaacgcaaacaacgttctgtcgagcaatttgccgatggatgttgaaaaaatgatgaaataagaaaaaaaatgataaaaagtgtaccaaaatgatgaaatgtatgatacaatgttaatcgtggtacagaagtaagaggtaaaaaggacatgagccctatattcgacagtgagattcaatttgagagcaagctgcctttgcattatcaaataatgatgatcatcaagcggaatattgcatcaaagaatatcctgccgggcgacaaactgccgacagaagaagaattttgtaatgtgtttggcgtcagccgctctaccgtacgcgccgctatcggcgagttggaagaagaaggcatggttacaagggttcgtggaaaaggaacctttatctcaaagacaaagctgaagaggaaaatggaacaggtatacagcttctcccatcaaatggaggcttcaaaccttgttccgtcctccaagcttatggaattcaaaacaattgctgcttcagacggtctgatcgatctgttcggccttcaagaaaacgatccggtgtatgagatcgtacgccttaggatggcgaatggggaacctcttcttttagaaacgacgttcctgcccgtgaaagtgcaccctacgctcaaggcggaaacgctggaaagcggctccttatatgattccctgcgggatgaagcgaagatatcgccgttcatcgcagaagaaacgtatgagagcatcgtgtttgaagaaagcatctgtaagttactggaatgtccgaatcctacatgcggcttttatgtagagcggatcacgcgccaggaatcgggcgatgcttatgagttgacgcagtcctttatgcggggagaccgttctaaaatttcgattactttgcagcaggatatctatacttttaatcgaagtattgactaaattctcttgacggagagaaggacatgttttacaattgacaagacaaacgcggcggtaaacgccggctgtcaatcattacaaaagtgtatttagagtttatccgcatgagcggataattaactaatattttatggaggaaagtaaaatgaaaaaagtcttagtagttgttatgtgcgtagtacttgcagctgcaatgctcgttggctgtacggcagcaccggcagcttccgagtcggcttctcaggctccggctgagtcggcatcggcagctccgagcgaaagcgcaagcgaaccggttcagtccgatgaaagcggcgctgaagcggaaacgggcggcgttacaaagatcgttcccgaaggcgacatcgtaatcggtatctctacaggttcgtccggtacgtcctggcgtgacatcatgatcgacaacatgaaaacagtcggtgatgaatacaaagaagccggcaggatcaaagactataagatcgtgaacaacacgacaaacggcgacgcaaacgagcaggcgcagattcttcgccagttcgtagacgatccggaagttaacgtgatcatggtgaaccctaacgacaacacggctctttccgaagttatcgctgacgcgcagaaggctggcaagctggtagttgtatatgacgctacggctgaggctccgggtgcgctgcaggtaacgctggaccactatgcttggaacaccaagaatgttgaagcgatttccgaaggcgctggcggcaagggcaatgccatcgaaatctccggccttgacggacatccggctaacaacgaacgtatccgcgcgacgcaggatgttctgaaaaactatcctgacatcaagctgctccagagcacgcctggtggctgggaccagacaaaagcaaaagaagcttctgcccagattttgtcttcgggtcaggaaatcgacatcgtatatacacaagacggtatggcatatggcgtactgcaggcgttccaggatgcaggcaagctgcccaaagctatgtatggcgatccgggtacggcattcttcaaggcttggaaagaattgcgcgattccggtgctgatttcaaagctttctcgcagccgaaccctccgggaatcggtgcaaccgcgatgcgtcttgctgtcaacatggcagaaggtaaagacctcgacgagacaaaactcgatggaaatatttactactatgtagttaactctttctatacggatgaaaactttgacgaaggttgggaacagttgaaagaccagtcggaagattatctgctgacagagtacttcacagaagagcaggctcttgaactgttcaaataatctagttgattaaaagcagaacttaaacttactacgggagcaggcatgaggcctgctcccgtagattaagtacatagaagaataaattcacgatgggaagggtgtgaattttggatggttttactggaagcgaaaaacataacgaaaagtttcggcggtgtcgcagctttaagtaatggaaacctgacgtgcaggaagggtaaaattacaggccttctgggcgcaaacggttcgggtaaaagcacaatttccaaaatcattaccggcgtatatctggccgacggcggtacggttacatataacggcaatgaggtaagctacaaaaacccgatcgatgcaaaaaaagccggcatttcgatggcttttcaaaacttgagcctgctgcccgatcttacggtatggcagaatatcgtgctcagttttgaaaagaaaaataagttgttcttagataataaggacgcaaaggaattatcccagaaaatattggatgagtttatgcccggattcgatatcgaaagacgggtaagcgaattagattcgagtgaaatgcagatcgtcgaaattgccaaagcgatttccgaagatccgcaattattgatattggacgaaccgacggcggcacttgagcaggcgcaggtgaaagcgctcttcaaatatatgcgcaagttggccgatcagggcgttgccatgatctttacatcccatcgcctgtgggaagttctggagatgtgcgacgatatcgtcgtgttccgtaacggcagcaatgtgggcgagatagactttgaaaagcaggagaaaaaccctgacgaaatcgtccgtttgattaccggagatgtggaatgtatcaatactgtaaaggaataccagccgatttccgatgaagcccaattgaagatcgaagatttgaattatggaaaatatctgcgagatgtttccctcgaagtcaaaaagggcgaagtgcttggtatcggcggacttgccggccagggacagacggagctcatgcttgcccttgcaggcaattataaggaagcaaagtgcacggcaacgatcgacggtgagccgatcaagttgacacagcctgtaaatgcggtcagaaagggtatcttacttgttcccggtgatcgtcagaaggaagggctgatgctcaaggactccgtgtatacaaacatgattttccccaaactggctctgaaaaagcaacctctctttacgcctacgaaaaaataccgcgaagagtgtgaacaaattgtgaaaacgttgtctattaagacggcggggatcgatctttccgtggacaagctctccggcggcaaccagcagaaagtcgtcgtcggcaaatggctgccgttcgacacgaatgtgctgcttttggctgacccggcgaagggcgttgacgtaggtgcgaaacatgatctttatgagttcatcatgaagatggtgaaagaaaaaaatatgagcgttatcctgtatgcaagtgacaacgacgaacttgtaagctattgtgaccgcgtattggttatgtatgaaggcaagatagtcggcgaactgaagggaaaagagattagcgatgaagcaatcgttgaaatgtcgctgcaggtaaaatcgcaggaagagagggaagtgcaatgagcgaaaaagaaatgacgcacagaaatggtttccagaagtttatgcacaggcccgaattcgcaacgctgcttatctttattgcgatgattgtgattgttgcggctctgcagggaaacttctttgagccgtcgtcacttcggaacagtattatttcgtggacgccgctgattctgctggcaatggggcaggcgatcgttattatcgccggcggtcttgacctttccagtggcccggcgatggcctttatgatgtgtgtcatggcgagcatcatgaaaaaggatgatccgtcgacaggtcttccggccttgttgatggggttggtggcaatgctggttgtgggtattgtcaatggcgtggctgtcggatacttgaagctgccgcctatcattgcgacgtttgcaacgtcttatgtatggcttggagcatcgcttttcatcatgccgacaccaggtggcgaatgtgtaaactggatgcgtgcattttatgattttgcatcggtagatgctatgcccgaggcgttaaaagcatttggacaggcaatcccgacgggtgtattgcttattattgcggcagttgtaatatggtattgcgtaagcaggaccaagaccggccgttacatttatgcggttggttccaaccgtacggttgcataccaaagcggtatcaatacttctaaagtacagctcttggcgtatatgatcaatgccatcttcattttcttctgtgcacttttcatggtagcgcagaatcaggcgggaagcgcgcgcatcggcgatccactgacactgcaatgcgttgcggcggcggtcgttggcggcgtagcgctaacaggcggtaagggaaatgtgttcatggcaatcgttggcgcgatcattatgagccttgtcagcaagctgatttatgttgcgaatgtagagagtgcatatcagtcgctcgtttcgggcatcatcattattgcggcaatcgcaagctccacgatttatacaacaatcaacgaaagggcattgttgaaaggggggcaagctaaatgaatccgcaggaaaatgcattgaagaaaaaggcattgggaaaaggtttccagaaatatagtaaacttgttattgcggcggtattgattgtagtattatttgccgtaggtgaaattgtagttaaaaatacgacaggcgggacatttgcctcttttgagcaagtcttgttgatgttgaaatttgcgacctacattgcattatttggtttagcgcagatgctcgtgattagcgctggcggcgatatcgacctttcggtaggatacatcgcgacgcttgtcgcggtattgtccgcaaagtttatggacggacaaaacgagaacctttggattgcaatcttaattgcaatcggtattggttgcttagttggtcttgcaaacggcctgttgacgcattttgtaaagctgccttcactggttgtcacaatggcgatggcaaacattttgcaaggcgttgtcaatgtctatgcggccggttccagtatttccggcgcgccttcaccggtactgaatgaggttgcggcaaagatgacgggtattttcccgaatattctgtgggtgctgattattgcgaccgtagtcattatggtaatcatgtacaagacaaaaatcggcgttaagctgctgggcgttggttccaaccccacggcggcgtacctttcgggtatcaacgttaagcgcgtaaggacgatcgctttcatgttcagcggtattattgcaggtctcgtaggattgttgctgatcggtaacttaggacaggcgtttaaggatatggcttcacaatatgttatgccgagtattgctgcggttgttgttggcggtatctctctcaatggcggtgaaggaaacttcgttggcgttattctgggggcggcggttctgcaaacgctcacgaacctgttcgttgcattcggatggggagatgccggtaagtggcttggatatggcctgattctgctctttatgctgatcgcatacgtacgcgagaaagttagcagataagatgaagaagcaggtttttaactgtatttaaacttatgcacaccattgtaaatggtagacgtttacaatggtgtgttttttaggggaggtaatgctttatgacaaagatgtatgatgaaattttacagcagccgcatgtgctcgcaggaatccacgcaaagaatgcggaaaccttgtcggcccttatggctgacatcaggagggcagatattaggcaggtggtgatcgctgcacgcgggacatccgaccactgtgcgatctatgccaaatacctgattgagatgcttctgaaactgccggtgtcgctttcggcgccatcggtaaatacactttatggtagtgatattgtatatcaaaatgcgcttgtcattggcatttcccagtcggggatggcggaagatgtactgagcgtcgtaacggatgccaataaaagcggtatgattactgtagcggtaaccaacaatgcacagtcgccgatggcgcaggaagcaaaattcaacctggattgcgcggcaggcctggaaaaaagcgtagcggcaacaaaaacgttcactgcgcagatgtactgcctggcaacactggttgctatgtggtcaggttgtaaggagctttccgacgcgcttgacgcgctgcctgaggggattggtcaggaggtcgcaaaggcacaagaggttatgtcgttggcaaaggaatatacctttatgtctgactgcatcgtgctcgggcggggactgcagtacccaattgccttggaagcttcactcaaaatgatggagacgacgtataccaacgcgaggggattcgcggtgtcggatttccagcatgggccgcttgcgctcatctcggataatcttcccgtatttgtgtattgcgcaagcgacgaggcgaaggacgacgttcttgccgccacaaaaaggtatgcagagcttggcgcatacatccttatggtaacggatgacgaaaagaatgcaaaggatgcggataagtgcctggtcatcgagaaaagctcgaaatatacggcgccgttccatatggtcgtaacagcccagatgttcgcatgcggcctcgcggaggcaaagaggtgcagcccggatgccccgaggcatatacagaaagtgacgattacaaaatagctggtaggaagcaaaatcccctgcaagaaatcgcgggggattttttatgcgaatttatggtataatgaaatcaaaaaccacaggaggaagaaagacatgctaaagggaataccggaaatcatttcgccggaactgatgaaaacgattatggaaatggggcatggggacgagatctgttttggcgacgtcaattttcctgcacaatctatgggaaaagaaaacagggtcattcgtgctgacggacatacggttacggatatgattgacgcagttctccagtttttcccgttggacacctttgtggaaaagccggtggcagttatagatcccgcagatatgccacgccccggggtatgggatgagtttgaatctattatcaaaaacagggatttttgcagcgcatataaagattttgaccttgtggagcgctttgaattttatgaacgtgcgaaaaaatgttttgcagtcgtagcgaccagcgaacatgctgcctacagctgtatcattttgaaaaagggcgttattttcaaataaagtagcaggagaataaaaatggattttacatttcagataccgacggagatcattgtaggaacagactgcatcaaaaagcatgcggatgtattcacacgcttcggaaaaaaggctttggtcgttaagtcgggctctacggaaaagaacggttcgcttggggatatcctggaggctttaaaggggcgggagatcgaggcaaaggtacttgcgtccgtgccgccgaatccaacgccggaggacgtgcagaggcttttggggtatgcgcctgcgtttgattttgtagtagccgtcggcggtggcagcgccttggatgcggcgaaaggggtcgcgattcttgcggtaaacgatgtagcgcctatggctatgtatgataaatcgtacaacaataagccgcttcccatcattgcggttccgacaacgtgcggcacggggagcgaagtgactgcggtttccgtactcactgtaggagattccaagcagtctttttccagcccggatattttgcccaaggtagcgtttttggatgccgaatatttaaagacgctgcccgagcgaatcatgctggacactgcgctggacgcgctttcccacagtgcggaggcttacctgcttgcccagtcgtggtcgaacgatatgatcgcggagcaggcgtttcggaattttgcaatgtataaggatgcgctgctaaatagggaagtaacggatcaggatagggaactgatgctttatacggcgacattgggcggactggcgatttatgcgggcggcacaagcgccgtacatacaatgggctatccgatcacggtattaaaggatgttccccatggcagggcatgcgcccttaccttaggggaatacatagaattcgtatatgatgcccaaaaagaaaaaatcgatacgatgtgccgcctgcttcatgtcgatgggataaacggattcaaaaaattgcttagggacctgatcggacagacggtttcgtacacggaagaagagatacaggagtttgtggatatcgcagcgctgccggcaatgaagaaacgaaatgcaaaacccattacaaaggatgatatttttaaattgtactgcagtgccttgtgtcgttgaaaatgaaaggaaaagaatatgacaaaatcactgggtgaagtctttcgttccgcatggaatgtggctaaaaagaattttgtagcgttgttcgtgccgacagttatttttgtcggcatactgtttttattatatgggatagacgctgtgggcgggattgccaattcgatgcgtatggagcaaatgggttatatgcagcagggtacgcctgtctggatcacgttggcgacggttggcgtatcggtctttctgactccactatacagtggttttatcactgcggtgctgcgctttacgcatataacgggccagccaacgccaatgcgggcagcatgggatgcggcatgtgcgaattatttgaaatatttgctgaccattttgacacagattttgtttaactttgtttttgctatagtaattgcgatcattgcggtggcagtattctttgcctcggtgtttccaagcgtgatgtcatggacgatgcatactcctgatgcgtgggaagggctggcaatgatcgtttcggcaatgattccgatgctgattgttattgctgtattagggtgggtttaccagttcagccagatgtttgtcacgtttatacccggcatggagcaaaaacagggattcaaagcgtttttcgatagttttcggtatatttaccaagggaatttctggaagaacttggggcatatccttttggcgggggtgatcagggtattgatcatgggacttatcgcagtgatattcttccttccgttttttatgaacgtggggctgcactttgattcgtttactacggcagagcagatactcagcccgcttttgtgggggctgccgctgtttatgctcgtcgggggattcgtatccgtattgttcaatgttcttttcatgccgtattatttcgaagtatacttgaatgccaaagcagaggtgaaccgcaaggacgcggcaaaaggcgcagtgatcccgcagcatatgccttaccggggataatgattcgacgtaaatcatttattgcggtcatgtattttcacgagcaagttagacggcacagggcgcgtctgttgtttgaagcgcagcgaaaatacataaccgcaatttagttagcaggtcaaaagtccatcttctcaaaggatttgacagattttttatatgccgtaaaagtaagcaggatataaagaacggtccctgcagcaagcgtggcaaattggtatcccaaaaatccggggaccatggtcttgatgtaatcatgaaaaaagggaacggcataggctgcgctttccacagctatgatgacagcgccgataccgatacaggctataaggaagggaatgccgatcttgcttgtatctttgtaatgcattgtgaaaaatatcaggttgaatacaccgaatacgatgaatgaaaagccgaaaaaggctatattggcgtccatgcctgcctcgttgccggatgggaacatcgaatggtttaacacggcgaacggtatagcaatgatgatctgcaaaagttctaaaaaaacgaccatcaaaaaacgcgctttgacggtatcctttttagggatgggaagcatcatggaatagtaattgtccctgttttcgcgcgcggtcatactcatcataaagatgcccaaacatacatagaaaaaaacgatcaggtatggatagcttggaatcagcagcatggaagaaaaagcgaggaacataatattgaccggatgaagcaccagcttcaattctttatataacaggtttttcatggtcagccctccttttcaatgtggaccataatatcctccaggatcgcatcgcgtattctggcatgatcgatcggcagatcggttgtgcgtataagcccgctcatgccgtgacggtcccgtttacagccgatgagttttgctttggtaacctccgtaatttggtcttttgaaaattcggcgaccttgtatttggccaggaaagtatccatttcctcgcaggcgattaccgcgccgtttttgatatagatgatattgtccgcgcatttctcaagatcagaagtgatgtgcgtggaaaacaggatactcatattttcgttctccacaaggtccataaagacatccaggagatcgtcgcgcgagacgggatcaaggccgctcgtaggttcgtcaaggatgagcagttccgcatgatgggacagcgcgagggcaagcggatatttgaccttcatgccttcggatagctgctcaggagtcttttcttcgtccagcgcaaacatttccatgtatttcctgtaagcctcatcatcccactgccggtagaaacggcgggtcacgtccgtgatcaccttcagttttttcttgggataatagtcgattccgcctgttacaaagccgaccttttgcttgatatggagttcatcttcagaaaaattcttttcccaaaagcggatgtcgccgccgtcaggatggacgaaattcagaagggatttcagcgtagtggattttcccgcgccgttgcgcccgataaagccggtgatactgcagggggaaagcgcaaagaaaacatcctccaaggaaaaagccggatactttttttcaaggttctgcacagatagtacgttcataaaatacctcttatttttcttcgctcttttcttcgcgtgccttccctaagggacttgtatttaggatttggttggtataatccacaaaggtctcgttcctgacgattgcgattccctgatggctgtccgcaaggagcagcaaggtatctcccggcttgatatcaaacatatcacgtgcggtttttggaatcacgatctggcccttttcgcctacttttacagttcccataaattttccctccggaaatccggatttttgttctgacatttccatacctccgattcatatatttcatacttgttatacttttcatacaaatcatacgctctgtatgcatcattgtcaatggaaataaaaaaaccccccgatgccgaaaaagcaaacggagggattaaagaggattgatgctggtattattttagaactctacatctttgccataaaaggcacaatcgagaacctttctcatggcagaaacatctgtgctgcgcgggttactgcccgtacaaggatcggcagtggcattttccgcaatatactgtgccactttcaggtaatcctcttcggagacgccattttcctgataggactgcttgatgccgagtttggcgttcagttccttgatggcgtctacaagcgaattgatgagctgctgggacgttgcacccggcaggccgagcgcccttgcgatgtctgcaaggcgttcaggtaccgccttcgcgttatattcaatgacaaacggaagaaggatcgcattgcagcgtccatgcgggatatcaaattgtgcgcccgttttgtgcgcaagagaatgacaaatcccgagcagtgcgtttgagaaagccataccggccatgcactgtgcaatatgcatatttccacgcgcctcttcattgccgtccacagacgccataatattttcataaatcatctgaatcgcttttaaggcaagcgcatcggagaacgggctgtgcagtgccgcaacatatgcttcgattgcatgcgttaaagcatccattccggtatcggccgttaaggatttcggcatggtaagcgggatattgctgtcaagaatcgcaatatccggcgtgatctcaaaatctgccaaaggatatttgatcaatgttttatagtctgtaataacggaaaaagcggtcacttccgttgccgtgcccgaagtagacgggatggctacgaaaatcgccttttgcctcagcttgggcatagagaaaggttctttgatgtcgtcaaaagttttttcagggtattcgtagaaaacccacattgcctttgccgcgtcgataggcgaaccgccgccgatggatacgatgacgtcaggctcgaattcgcgcatagcctgtgcgccgcggtataccgtctctacggacggatcgggttctacaccctcaaaaagccgggtctcaagaccagcctcatgcaggatgctttgaagcttatccaaaaaaccaaatttctgcatggaacttcctccggtcacgatgatcgccttcttgtaacctttcaggcaggagagttcttcaattgcattgggaccaaaatacagatcgcggggcagtgtaaatcttgccataaataatctcatcctttcataaaataatctacataattatatataaacagtttgttaaaataatatcaatacaatttttcgcgtaaagagggctcagattttgcgtttttatgtttcatatggtaaatttgccgcgtggtgtagagggccggcagatgtgttataatacaggtatgcaaaagctggcgaaatatctgaaaaattacaaaaaagaagtgatattggggccaatattcaaactcacggaagcgatcctcgaattgatcgtaccgctgattatggcgaatattattgatattggaatcaaaaacagcgacagtgaatatgtatggcgcatggggggactgatgatcgtgcttgcggcggtcggacttacgtgcgcgctgatctgccaattttttgcagctaaagcgtcgcagggcttcggaacagaccttcggaataagatgtttgcgcatatcggcagtttatcgcattcggaaattgataagcttggtacgccttcgctgattacgcgtatcacaaacgacgtcaaccagttgcaggtggcggtggcaatgctgatccgcctggtgatccgcgcgccttttttagtcattggggcgacggtcatggcgatgatcatcgatttgcaaatgtctattattttcctgatcgcggcggtgctcatagcggtcgtcctctatttgatcatgagccgcagcgtacccttttaccgcatgattcagaagctccttgacagggtatcgctggtcacgcgcgaaaatctttcgggcgcgcgcgtcatacgtgcgttttccaagcaggaaaaggaaaaaaaacggtttgcggaaaccgtcaatgaacaaaaggacgcggcggtccgcgtcggtaagatttcggcgctcttaaacccgcttacctacctggtcatcaatcttgggatcgtggcggtcatctggtttggcggcggggcggtgaatacgggacatttggagcagggacagatcatcgcattggtcaattatatgacgcaaatacttttggcactgatcgtagtggcgaatctggtcattatttttacgaaagcatccgcgtcagcggcgcgtgtgaatgaagtaatggatacgcaaagctctttgagcgacgaaggaaatatgccgaaagaagtgcccgcgggagaggatacgccgaaaattgaatttgacaaggtatcgtttgcatacgacgacagcggcggggaagcagcgcttgttgatgtttccgtacgcatttataccggacagacgatcggcgtaattggcggtacgggaagcggaaaatcgacgtttgttaacttgatcccccgtttttacgatgtgacgcggggcagggtatgcataagcggcgtggatgtgagggactacaggcttgctgatttgcgcgggaggatcggtatcgtaccgcagcgcgcggtgctgtttacaggcagcatacgcgataatatgcgctggcgcgacaggcaggcaacggatggagagatcatagaggcgctcaaggtggcgcaagcctatgaatttgtaaaaaaaatgccggaaggattggatacgctcatattgcagggcgggcagaatctttcgggcggacaaaaacagaggcttacggtcgcgcgggcgcttgtgggggatccgcagatcctgattttggacgacagcgcgtcggcattggatttcgcaacggatgcggcgctgcgcaaagcgatacgacaatttggcaaggggattacggtgatcatggtttcccaacgggcggcaacggtcaaaaatgcggacaagatcatcgtatttgatgaaggcagcgtagcggggatcggtactcatgatgaattgtttgaaacgaatgaagtataccgtgaaatatgcctgacgcagcttgaaaaaagcgaggtgggcaaatgaacaagacggtgatcaaacgcttgcttggatatttgaaaccatatagcggatttttggtgtttgcggttatcagcgcagtcatcaacgtagcgatgacgttatgggcgccggtgcttataggacaggcggttgattttatcgtaggaaaaggaaatgttgattttgccggcatccttccggtactggcgacattgggggtggcgatcggactttccgtgctgtttcagtggctgatgacactgtgtaccaaccaggtaacgtaccggacggtacgtgatttgcgtatcgacgttttcaataaattaacagaggtccccttaaggacgattgacggcagagcgcacggggatctgatcagcagggtagtgaacgatatcgaccagatatcggatggcttgctgcaaggcttttctcagctctttaccggggtcgtgacgattgtggggaccttgctctttatgctgtcgatcaacgtgtctatcgcactggttgtaattctgatcaccccgctttccttctttgtggcgtcctttattgccaaacggtcttttaatatgttccgcaaacaggcggaggtgcgtggagagatcggcggatatgtggaagaaatggtcggcaaccagaaaatcgtgaaagcgttcggatacgaaggagaggcgcagaaaaggtttgaagaaatcaatggcaggctttattactttggcgttcgttcgcagttttattcgtccatgaccaatccgtgcacacggtttgtgaatgcgatcgtttacgcggcagttggtatcgtgggtgcgctgagcgcaatctcgggcggtatttctatcggacagctttccagctttttgatttacgccaatcaatatacgaagccgtttaatgagatatccggcgtggtaacggagttgcaaacggcgcttgcatccgcgcggagggtgtttgagatattggatgaaccgtcagaaacaccggacagcccgaaggcattggtgatgaagagaagcgaaggaatagtcaggctcgaagacgtatccttttcatatactcctgaccggaagctgatcgagggactgaatctggttacaaaatcaggtgagcgcgtagcgatcgttggacctacgggcagcggcaaaacgacgatcatcaaccttttgatgcgattttatgatgtggacaaagggaaaatcagcattgacgggacggatataagaaccattacacgaaacagcatgcggagtatgtatgggatggtattacaggaaacatggctgtttgcgggaagcgtacgcgataatatcgcatatggaaaaccggatgcaacggatgatgagatcatcgctgctgcgaaagcggcgcatgcgcatgggtttatcatgcgtttaaaggatggatatgataccattattgcagaggatggcggaaatatttcacagggtcaaaaacagcttttgtgcattgcccgcgtgatgctggtggagccgccgatgctgattcttgacgaggctacgagcagcatcgatacgcgtacggaaatgcagatacaaaaggcatttgaaaaactgatgaagggccgcacgagctttgtggttgcacaccgcctgtctaccatccgtgaagcggacatgatccttgtcatgaatgacgggcatattgtagagcagggaacgcatgatgaattgcttgcaaggaagggattttatgcgcggctttataacagccagtttgaaaaagagggttagagtggccggtttgtgtctacatatagaaaaaaagaggtagacagcatgcttgaaaaattgattgcacgtgtgaatgaaacaaacaaggaactcatcttaggagccctggaagaatgcgaaacgccggaagacatcaaccgggtggcggaagcctacggcattgatatttctgatgcggaaatggattacctgctgaaccgtaagcagggggaaacatgctccgaataatgtaatatccggagctgcgcgtgggggatgggtcagtaaatatttccaccgccatactcctcgataaactgttcatagctgcattgtttatcgagaataccatccggcgtaaaacggatgatgcggtttgcgatcgtatcgataaactcatggtcgtgcgaagcaaacagcaccgcgcccttaaaatccatgagcccgttgttgacggcggtaatggattcgaggtctaaatggttggtcggctggtccagcacaaggatattggagccgaacatcatcatccgcgacagcatacagcgtacgcgctcgcctccggagaggacctttaccttcttgaaaacgtcttcgccggaaaacagcatgcgcccgcaaaagccacgcaaataggtttccgtcgtatccttggaatattgacgcagccaatcgagaatatttaagtcgcaatcgtcaaagaatgcggagttgtcttttgggaagtaagactgagtcgttgtaccaccccatttaaaggttccttcgtccggctccatttcctccatcagaatctggaaaagggtcgtggctgcgatttccgtatcgccgataaaagcgatcttatcctcgcgccccatggtaaagctgacatgattcaataccttttcaccgtcgatcgtcttggacaggttttcgacggtcagtacctctttgccgatttcgcggtcgggtgtaaaaccgacaaacggataacggcgggaggaggcgggcatttcttcaaactcgagcttgtccagaagttttttgcgtgaggtggcttggcgtgatttggatttattggcggaaaaccgctggataaaagcctgcaattctttggccttttcttcatttttcttgttctggtcgcgcatcattttctggatcaactggctggattcgtaccagaactcgtagttgcctacgtacattttaatcttgccataatcgatatccaccatgtgtgtgcataccgtgttgaggaagtggcggtcgtgcgatacgatgatgagcgtaccttcataatccatgaggaagtcctccagccagtgtacgctggaaacgtccagatggttggtcggctcatccagtaaaatgatgtcgggtttgccaaacaacgcctgcgcaagcagtaccttaattttctcattatcaggcagagaggacatcggctggtataggatatcctcggagagtccgagcccctggattagcttggaggcgtcggattccgcttcccagccattgagctctgcaaattcgccttccagttcgccagcgcggatgccgtcttcgtccgaaaagtccggctttgcgtaaagcgcgtccttttctttcgtgatctccgcaaggcgagggttccccatgatgatcgtttccaataccgtatattcatcaaacgcaaagtgatcctgcttcaagacggacatgcgcgtgttttcctgtatgtgtacgtcgcctgtcgtggattcgagatcgcccgacaaaatacgcagaaaagtagatttacccgcgccgttggcgccgatgatgccataacagtttcccggcgtgaacttgaggttcacacctgaaaacaggtttgttccgctaaaattaaggcttaaattcgttactgttatcatttcatgctccattaccattttttacccaagtccgtccattataccacaaaacaggcggatatgttaaaatagacatattaatttaacaggagacggcaatgaagctgaaagaaacggtatcgctctggcaaaaactgaaggagacaagcaagccgatcgtgctttacggcatgggggacggcgcggataaaattttagatgagcttacgcggcgtgagatctgcgcagcaggcgtatttgcgagcgacgaattctgcagggggcaggtgtttcgcggcttttcggtgacgaattatgcgcaggcgtgcgaacgcttcggcgatatggttgtgttaattgcgtttggaacgcagcttccggacgtcatggacaggatcaggaatattgcggcgcagcaggaaacctatgcgccggatgtgcctgtgacaggcgggaaagaggttttcgacgcggcttatgcaaagcggcatgcaggcaaattggaaagcgcatatggtatgctggcggacgacctctcaagacgtacatttatggatatggtgcattacaagataagcgggaagctggattatctgtttgattgtgagagcggcgtgcaggaaagctaccgcgatattttgcagttggggcaagaagaaacctatgtggatgcgggcgcttatacgggcgataccattcgtgaatttctgaaatacacaaaaaaataccgcagaatcatcgcggtggaagcggatcgaaaaaatttctcgaagttggagaaaaacacacagggcatgcataatttatcgctgtatcaatacgcggcctacggcgaggatacagagatcgtatttgatacccgtggcgggcgcaattcggcggtcgggcaacagggcaagattgtgtgtgcgcggcgtattgacagtatcgtcggggaagaaggggcgacatatatcaagctggacgtcgaaggacaggaggccgcagccctgcgcggggcggtcaagaccatacaaagatgtaagcccaaactgctcgtttccgcatatcacaggaatgaagatttgttcagtctgcctttgctgctgcacgaaatacgcaaagattaccgcgtctatttgcggcattttccgtatatccccgcatgggatacgaattattattttgtataaaacagggcttattttgatggcgaaacagatactttatcggttgcttccagcttaaagatcacggggcgcagcccatcgttgcacgctgcgatcgccacgccgggcgttttgatccagtcgccgtagtagaacagggaattttccgcgccatgcgcgagtgcaaacacatattgatagatcgctttccaggcttcgtcgcaaaagccctcgggctttgcatagtccgcaaaaaacacctgcccggctttgagcatcggacaggggccgagcccgtcaatgccgtattcggcggcgagctccttatcgagcgttgtttttaatactgtgatcttgacctgtttcattgtattcctgttttccatatcgatcgcccccatgttttttaaaattataacacaaagaaaaaagacgtgcaccactgtccttgcgtgaagcacgtctttggtttgtgaggcttattctgtcctgagcgcgtcgatcggcgccatttttgccgctttattagcggggttgatcccgaagatcacgccgatggccatggagaagaccacggcaaggagggcaatcccgccggacatggtataggtggtatcgagcgccagtgaaaggatcgcaagcagcgcccaagatgcaccgaggccgattagtccaccaaccgtactcacaacaagggcttcgatgagaaattgcagcaaaatgcgcttgcgtcccgcgccaatggctttgcggataccgatttcccgcgtgcgttcggcgacggatacgagcataatgttcatgatcccaatcccgccgacaaggagggaaatacctgcgatcccgccaaacatgagagacattgtgttggtgatggaatccatggattcaaggatggtcgactggttcataacgttgaacgcgtcttcgtccttgaattttgccatgagggcggaggtaatatcttcttccgcctggtctacgacggcagagtcgctggccgcaaccgtaaaagaagttacgccggagacatagaacatacgctgcgcagtcgtatagggaatgataatattgctgttttccgaccccatcaaactttcacccgcatccgccagaacaccgacgacaaggaaactccgcccatccacggagatcgtttcgccaacaatatctgtcctgccgaacaggtcgtccgcaaggtccgaaccaacgactgcaaccgctgaattattgtctacgtccggcgatttgataaaacgtccggattgcaaggaaagatcgttgatttcggcataagacgatacactgccgatgacgcttgccgtcgtcgaggtatcgccggccttcagggttgcgctttgcgtcgtcgttgcagcagacaggctgatgctgtcgtattcgtctgcaaatgcattgacttcggaaagggttaggggctggtaacgggaactcgtgacagatacactgatggtatttgcccccaggttttcaagagccgaggaaacggagcttgtagcgcttgatacgatggagaccagtacgacgactgccataataccaatgatgatgcccagcatcgtcaaaaaggaacgcatcttgttgccccagatagaggaaaaagccatgcggaaagattgtaatatcatgcctgcgccccctccataacccgaccgtcaagtattctgatgcgccgttgcgcctgcttggcgattccatcgtcatgcgtgatcaggacaatcgtattgccgttttgatgaagctctgcaaacagctccaatatttctacaccggttttatggtccaggtttcctgtgggttcgtccgccaagatcagtgaaggatgagcaaccagcgcgcgcgcaatcgcaacgcgctgttgctgtccgccggaaagctcggtcggtttgtgatggatacgctctgaaagacccatgcgtgaaagcgcttccatagcccgctcatgatactcttttttttgtaccccttggtaaatgagcggaagctctacgttttcaagcgcgcttagtttgtttaacagattgaagttctggaatacaaaaccaatcttaaaattgcgtatgcgcgtcagctcatcctcggagtaatcatcaatggcttgtccgtccagcatatattcgccactgtcggctgtatcgagacatccgatgatgttcataagcgtagacttaccgcttcccgaagggccgatgatcgctacgaattcgccatcatgtatctgtagggtagcgtggtttagggcatatagttgttcgtttccgatttcatatactttggaaacatctgtcatttgaatcataagttgtcctccttagccgcccatcggtccgccgccgttgccactgggcatattgccgcggtcaggcatctcgccgcctcccatgtctccgcccatacctccgctcatgccacccggaaaaccggattgctcctctgcggaatccatcgaggcggactcggtatacataacctgttcgccttcggaaagtccggaggtgatctcgacattcgtaccgtctgaaagtcctgtttcaacgctgcggcgttcaccgcccatgtcgccgtcttcgctgccggatgccgcatcgccggcgaccagtacgaatttttcgttgccggattcctgcaatgcgtcaagcgggatcagcaaaacatcctcgctggtagcaatggagatggtcgccgtcgcattcatacctgccatgatgcttgcatcgtccacgtctgtaagcgtgatggtgacggggtaggttgtcacaccggattggatactgccggatgcggatattttggccactgtgccgtggaacgtatcgtcagggagcgcatccaaaacaatggtaacatcctgccctgcctgcacggacatgatatccagttcgtcgatactcacggtcaatgtatcggctttgcccgtagaaatcgtgaatgccgattgcagcagggagctttcgcttgagccggaatcggacgaggacgcggcggatgcggtcgcggagacggagctgccggatatggatgcgcctgcagagcctcccgagttgcccgaaccaacagaagttccggatgatccactcgcaaatatggatgcagaggaactgctgtccatgtcgccggaaggctgctgggacgtatcggccttggctgtcgcagggaatactgcgctgaaggtcaacgtattgccctgagcctcagggctgatcacaacgctctggggatcgacttgtgcgcccgtgacatttacggtcgcatcctgcgcaaactgatggctgctgttcgccgtcagggtcacgacggcagtatacgcggtatccgcggcaaattttgtatcggagggggtccaccggatcgtgccggtgtagccgctgcccggcataatagttgtttgcggcgtattacctgtgacaggattgttgatatagatttccgttgcgccggtaatgggcgtcacgcttccggtatcactgctaagatcagaggatagcagggtaatggcagtatcggatccggtaagggagtcggacgccacagcagccgaggacatgcccgttgctgattgcgctgaggattgcgagtttccggaggaagaggaggaatcagatgtcccgctgatggaaacgctgttgatggttccgcttgcctctgccgtgactgtatttgtctgggcatacttcagcagtagccgcagcacatcctcgtattgcttgcgctcggcaagcagggaagcgtattcttgggaaacgcctgcttccgtaagcgtgatcagtgtcgcgccgctgctgacgctctcgtttagattcacatcgacgctggcgacggtgcccgcattaccgaggatctcgataggcgtattgatctccagcgtccctgagccgagctggttgccgtccgaatctgtaaccgtcaccgtatccccatatgcagggccgttgtcagtcatggtaacgacgcaggaatcggcagaaaccgatacaaccgtacccgttacggcactgctgtctgacagcgttaccgtaacgctgctgccggatgaaagcccatccgtggaagagggcttgaaagttaccttcattttaccgtctatggaaagcaccatcagggagccattttcggaagttgtggtttgggtatccgtacccgcttcggcaaaaatctgctttacgcgtcccgatacggaggtggtgatatatttggacgaggtatcgcctttggcatcgtcgatttccgaatcgagggtggaaagatcggactgtacgcttgcaagcgccgtctgtacggatgcggggtccagagtggcaagtgtgtctccttcgcttaccgtatcgccttcttcaacaagcacgttttcaaccgtcacatccgaaggaatcatcatatcggttgtattttgtgcagtcaggttcccggaaccgacaacagtagtttcgatcgtgcccttctggacagtggctgttctcatggctgatgccattgcaagagaatcattacggagaaaattaggcaataaaaaaattgcgagcaaaactgccgcaaggataatggcaatcaataccacccattttttctttgtcatctttttgtttttcttgttcgtagtcataacgcctcctgaacacctttgtttttgatcatgcgttcattatgaagacactatgtgaaggttatatgaaaaccaggtgaaaggagccttaatattaagaggatgccaggtgttttctgcattgacttttggtagggcatatgctattatttctaagtcgattattgtagccgaagtggtggaactggcagacgcgctggactcaaaatcctgtggtagcaataccgtgcgggttcgattcccgccttcggcaccatgagaaacagaattctgcttttgcagagttctgtttttgtttcaggaggaatcggctcctcgtgggttcatacaagccaagcatagggcaggcgcgctttcctaccttcgatacagaatttttccgtagaagtaaatgctattttttaaaatttttttaatattgttataaaacactcatattt

SEQ ID NO: 22 - DNA, 18236 bp, Christensenella sp.
taataataaatatattttttgccttgacattgatattacaaagtgatattatatgtttattcaataaattgtatacattctatcatttttgcatacataatctgtttaataattaaataaagttttagtcgattattttctatactgttttcgctacgctctcaatacctaacaggtttacatggcccccccgcctgcgacgagttgtcgcaatagctgatccagtctcaatgtacgcattgcgtacagaaataaaagggaagaaggagaagagcatgaaaaaaaacttaggtaggattgtaggaattgtcttatgtctttgtatggtatttacattagcagcctgcgggacagatactccggctccgtcagccagttctggcgggacagaaagccaagccgccccggagggttccggtgaagctgcggcgcccaaagccaatgaagatattctcgttggttttgtagctctgacgatgacgaatccttatttcgccacacaggcgcagcaggtccaaaaacactgcgaagagaggggttgggagtgcaaagtgtacgactcccagatgaattccgaaacggaattagcagcttttgaggatctgatctcccagcaggcggacctgatcattgtcgataatgtggatcctgaagccgttgtagcggcaattcagcaggcttacgacgcaggaatccctgtaatcgggatcgacagcctggtagatgagtctgctcccgtttctacagtcgtaactgctgcttccaaggacggcgcaatcgaatgcggcctgtggctgggtaaaaaaatggatggtgccgctattaaggccggcgtcatcagtggtgtaaaaggaaacccgatcggtaaactcagaagggatggactgtttgcagggattatcgaaggtatgtatgaagtagcagggactcccgtagataaggaaaccgcatggaaagaagcggaagaaatggaagaccagcttacgagtgcaggcgctgcaaaacatcctactctcccattcgaacttgtttcccagggctggggcgcatggagcgcggaaggcggcctggatgcgatggaagatatcatcacggcacaccctgatattaatgtcttgctgtccgaaaacgatgatatggcaatcggcgcgctgaacgcgatcacggaacgcaacttaaacgaccagatcacgattgttgccggagcggatggccagaaggaagcatatgcgctcatcaaggaaggcaaatacggcgctacctccgagaacaaccctgtcaagatccctcaacttgcatttgaaattgctgaccagatcctgctcgagggaaaagatccctatagctttgacaaagtcatccagacagaagcagtctgcgttaatgcagacaacgtagatcaatattatgacgaaaattcaccgttctaagcctgaatagcacattagccaatgaatggcacgcgcagcgcaccataaccaagtactgcgcgtgccatcattctaaatagaaaagaggactatgatatgaaaccgtttgattttaattttccaacacatgttttaatgggcgtaggccgcatcaaggaattgggaatacaatgcgaacaattcggtaaaaaggcttttgtcgtatatgatccgttcctgaaaggaagccggctcgtagaaaatatacgaaaggatttaagcgaccatcaggtttcttaccttgaatattatgacgttgttcccaacccgcgcaatacgtctatcgacgaagggatttcgctttgcaagaaagaaaaatgcgagatggttgttgtagtcggcggaggcagcgcgatcgatacggcaaaggcgatcgcactcgtggctgtaaacggcggcacttgctgggaatataccgaacgccagaacgaagacgtcacacgtccgtcttctaagggccttcccactatcgttattcccacgactgccggtactggatcggaagctacctgcggtgctgtgatcaataatccgggcttaaagcgtaaatgtacgattatcaatccttacctttatccggatgtatccattgtcgatcccgaattgaccgtttcccttcccgcacagacgacggcgctcactggccttgacacgtttgcacatgcctttgaagcatatatctgcaaaaatgcaaatcctgcgtccgaccttttggcgctgcaatccatggaatattttgccgcaagtatacgcggcgccgtaaatgacggtaaaaaccttgaagcccggtccggcatggctatggcctgcgctttgggcggcctcgctattttccatgcaggagtcgtactcccccatgcgatcggccagccgctaagcgcccttaccgatgccccgcacggcggaacgctcgcagcatgcatcccacagattattgaatggacgattccctatgcacaggataggtttgccaaagtagcggaaatactggatgccgaccttacgcaaggtatgaatgaagaacaaaaagcagcttcccttccggaaatcctgcataacctgtaccgcgacctgcatgtagatgtctccttctccggctatgggctcaaagaagaagatatcgaaagtcttgtcgacttaagctataccgcttttaaacaggatatcgacgggcatccaaagccggtcacacgtgacgatgtcgtatatatcgttaaacaatgcatgtaagcgtaaaaacggaaggagggattggtatgggcgcggaaacactcactgtcgagatgaaaaacatcgttaaaaaatacagtggcgtctacgcactgaaaaacggctgcattactttaaaaagcggccagatacacgcccttgtgggcgaaaacggcgcaggaaaatccaccttgatgaaggtcctttccggcgccatatcaagggacggcggggaaatccttatcaacggaaaagaagctgaaatccacaccccgcatgacagtaaacggctgggaatttccattgtatatcaggaatttgcactcgctcccgaccttactgtcgcagaaaatatctatatcgaccatcttaccggtaaggcggggctcgtaaactggaagcagttatataaggatgcacaggcgcttctcgataaactgggcttttcaaatgttaaagccagctccaaggtttatgagctttccgtagcacaccagcaggttgtggagatatgcaagtccctttcccgtcatacaagggttctggttctggatgaacctaccgccgtactgaccttcagcgagatcgaaaaattatttggcctgctcaatacactcaaaaacgaaggcgttggtatcgtatacatctcgcaccgtcttgaggagatatataccatatgcgaacgggctacaatcatgaaggacggggaatttatttccgaacataaagtaacggatatcacaaaagaagcgcttatcggcaaaatggtgggacgtgaactggaagacctctatcccccgcgcaaaaaacgagaactgggcgaagagatcctcaaggtagatggcctttcaagcgggagagaagtaagggatgtttcattttccttgcgcaaaggcgaaattctgggcttcagcggcctcatcggcgccggacgtactgagacaatgcaaacgattttcggcgtccgtaaaagggacggcgggaccgtcacctttatgggcaaggaagtggacttcaaaaatcccaaagaggctgttgacaacggtttggggatgctttctgaggatcggaaacattttggtatccttcttaaccagccgatacgcgtcaatacgacaatcacacgtcttaaggacatcactcgttttgggagcagcggcatattgaagctgaaaaaagaaaagaaaaaggtcctggagcttttgcaggagctcgcggtaaaataccgcagtattgaagacgatgtttccagcctgagcggcgggaaccagcagaaaatagcgatcgcaaaatggttgttctcgcaatgttcctgcgttatcctcgacgagccaacgcgcggcgtggatgtcggcgcaaaggtagagatctacaagatcatcaacaaacttgtcgattatggcgtaggcgtcatcatgatctcgtcggaaatgctcgaaattataggcgtttgcgacagggttctggtcatgcgcaacggcagtatcaccggcgaagtatcctcgcaggaaatgttaacggaaggaaacctgatcagtctggctatgggtgtagaatcatgaataaagggagcgaaacaatgaatagcaatcaattgggccgtcaaacacatgtcggcggatttttcaaaaaattactgctggattacaacacgatcctgatgctgatcgtcctgatcattatatccagcatcgtatcagacaaatttttcacagcgaacaatatcttaaacctgctccggcaaaacgcgggcgcgatgatcgcagccatgggcatgctgtttgtcatcctgacaggcggtatcgacctctctatcggctcaattgcggctgtcggcagcgttatggtggcaacctgcctgtccacactgaatctgggacttttcccagccatcttactttcgctggtcatcggcttgctgttcggccttttcaacggcgttatggtggccgttgtcaagatggctccgtttattgccactttggcgatgatgacgatcgccaaaggtgtggccctgatgatatcaaacggcagtcccgtcaagacgcctacaggaacgctggatgctatgggtacggctaaggtcggccctatctccggtctgatcgttatcgcgatcatcgtcgttattgtgtttttcctgatccacaagtatacagggttcgggcgtttggtcgtggcgatcggctctaatagcagcgccgtacgcctcgcaggtatccagacaaaccgttatgtcatctccgtatacgtcatcagcgcattatgcgccatcgcggcaggcattatcacggccgcacgcacctatcttggtaatccaactgcgggcgacggactggaaatggatgccattgccgcagtcgtcatcggcggcggcagcctggccggaggccgcggctatgtattcaggacccttgcgggcgttatcatattagggctgatcagcaacatcatgaacctggtaggcgtcccgccttatccgcaggaaatcgttaaaggcttcatcatcatcggtgcagttgtcctccagagcgtaacggacaaaagatcttaaataataaggcaaaaacagtaaaaatagaaagcaggtaaaaatcatgaataaaagaagagcacaggcaaaagagaactttagtaatggtttcaattgcgcacaatccgtattcttatccttccaggaggtacataatatcgatcccgaaacggccgcgcggcttgtaacctgccttgggggcggtatctccaaaacgaagaatatttgcggtgcgctttccggcgcttgccttgcaatgtcttccaaatgcgggaagaaagacccgagcgaacctgagcgccaggcgcaaacttatgaaaacgcacagaatatgatccatacattcgaagaagagttcggctcgacatgctgccctgtccttctcgggtacgatatttcgatccccgaagagcttgacaaggctgtggaagcagatgctttccaaaaaacctgccaggcgtatgtgcagagggctgccgagcttgcttcggaatatgtcgacgacaagaaataacctacggaaagaggaaacagacaatgacgaaaattgtaattgtcggcggggtcgcgggcggcgccagtacagccgcacgcctccgcaggctggatgaacaggcagaaatcgtattattggaaagcggcccatacatctcgtttgccaattgcggccttccctactatattggggatacgattaccgacagggacgaattgctcgttatgacgtcccggggttttcaccggcgtttttgcgtagacgtcagggcagaaaacgaggttacttccatagaccgtatcgccaaaaaagtgcaagtgctcgataaaactaccggcgcggcttatgaggaaccttacgatatccttgtgcttgcgacaggttccagcccgcttgttccaaatatcgacggtatcgacagtgaaaacatctataccctttggaatatgcaggataccgacctcttgaaagcgcgtatccaaaatgaaaaacccaaaagcgttgctgtcgtcggcggcgggtttatcggccttgaaatggttgaaaacttacgcgaattggatatcgacgttacgttgatcgaaatgcaaatgcaggttatgcctaatgtcgatgccgaaatcgccgcagtcctgcataacgtattggaacgtaacggcgtacgtctcatgcttggcaagacggttgtcgcttttgaggatacgccgcagggcaaaacactgacgctcgacgacgaacagtcggtcgattgcgacatggtgttattgtgcatgggcgtacgtccaaacagcgcccttgcacagcaggcagggctgcgattgaacgaaaggggcggtatccgcaccaatgaatgcctgcatacgtcggacgaggatatttatgccgtaggagacgtgatcgaggtacagcatttcatcaacggttcccctgtcatgattcccctcgccggccccgcgaataaacaagggcggttgtgcgccgacaatatcaatggcgccagcaagccttacaccgggacgcaagggtcttctgttgccaaggtgttcgattttacagttgcctctacagggctgaaccaaaaccagctcgaacagtcaggcctcacgttgggcaaagactattttacggtcaaaacgcatgcgtggtcccatgccacctattatcccggcgccacacaattcgcgctcaagcttttctacgacaaagacggcaaaatattgggcgcgcaggctgtcggcaaagcgggcgtggataaacgtatcgacgtcattgctgcagcgatccgctttggcggtactgtagaagatttgacacggctcgaactttgctatgccccgccgtatgcttccgccaaggatcctgtaaatatggttggtttcatggcagaaaaccagaggaatggttatgtccgcttcattcaatatgatgcgctcgaccacttcgacccatcttccgcgaccatacttgacgtacgcgagaaaagcgaagtggaggcaggctgcatcagcccgtccgtccatatcccgctcggcaagctgcgcgagcgtctgcatgaactggataagaccaaaccggtcatcgtggtatgcgccatcggtctacgggcttatgtggccaaccgaatcctgatgcaaaatggattcgacgatgtatgcgtattggcaggaggatatacgaccttcaaacaaacgaggaatctttaccgctaatatattcagaaaggaaaatacgatgcgaaattttgattttcagaatgcgacacgtatcattttcggcaaggatgccgagaaatctgtcggcgctgacttaaagccgtcggccagccatgtattgtttgtccattatggcgacggaatgattgaaaagctgggactctacgacacggtctgccgttctcttcgggaagcaggtatccgctacagtgaattttcaggaatacagcctagccccgtattgagcaaggtacgggaaggcatcgaatattgccggaacaacagcgttgattatcttctggcagtaggcggcggaagtgtcatggatactgccaaagccattgccgcaggcgttccctatcagggcgacgtatgggactattttgacggaaaaggcggtcccctgacagaggcattgccgactgcagcgattgtcacctaccctgctacgggcagcgaaaccaacacgggatgcgtgatcacaaacgaggacggcatgtataaacgctggatagatgccaatgtcctgcgcccgcagatcgcttacctgaaccctgagctgacctatagcctcccgccctatttgactgcgtgcggcattgccgatatgttcacgcatgcgttggaacgttatatgtgcaatgactggcatgtcgatctttccgaccgcatcggcgaaggctgtttacgcagtatcctttatactgcgcgagacgtcatggccgctcccggggactacaatgcccgagcagaaatcatgtatgcaggcttgttcgccaacaacggatacatcagcatcggtaagcagtgcggatgggaaagccatgccatcggccatgagctgaccgcattttatggcgtagcacatggcgcaaccctgtctattatctatcctgcatggatgcggtacgtccgcaaagcaaatccccagcgcttcctgcagtttgcttcgcgcgtatttaacgtcgactatgcttataaccgcgcagaagatgcaatcgaggaaggcatatgccgtatggaaaactttttcaggagcataggacttcccgtacgtatgggcgatatcgatattgacggcagccagattactgcaatggcgaaaaaggcatgcagtatggggccgcttgacggtatcatgccgctgcatgaaaaagatgtcgaagcaatatacaggctggccttgtaaagccgtttatcaacgaaacaattacgacaaaaggatggaaaaaaccatgaagatgattatcaatggaaattttgtggatgcaagcgacaaaggaaccagtaatgtaatgaatcctgcgaatatgcaggtgatcgacactgtccccgctgcgacaagccgggatattgacgacgcacttatggctgcgcagcaaggtaaaaaagaatggaagaataccgttttatacgaacgggtcgcaattcttcgcaaatttgtctccctgcttgaggaaaacctggacgaattctgccacatcatgtgcgcggaaagcggaaaaacatacgtatcctgtatcgacgaagcaagggcgtgtatgggtatctttgaatcctattgtgaaaaggcaaaaaattatggcggcgaaaccctcccgatcaattcagaaccccgcgtaaacggagatattatctttacggtcagggaacctttgggcgttgttgcttgtgtcgttccgttcaattaccctacggagctttatgcacataaggtcgcacccgccttggtaacgggtaatgccgtcatcatcaagccttcgagcgatacccctatgggaaatatctatcttaccaagctactgcttgaagcaggcgtgccggcaggtgctgcacaggtcgttacaggcagcggagccaaaatcgggaaacagctcgctctcagtcctttgatcgatgcgataagcctcacaggcagtaccgaggtcggaatccagactgccgaaaacgctgccaagcatcttacccatgttttcctggaactgggcggcaatgatccgctcattattttcaaagggactgaccttggccaggctgtcgaagaaacgcttgcagggcgtgcaagcaatgcaggccaaacctgctgcggaaccaaacgtattctggtagaaaatgcaatcaaggaagaatatacgaatcaattgctggatgccttgaagaagctcaaggtcggcgatccccttgatccggcaacaacgtacggcccgctcatcagcgaacgcgcggcaaaagacgtagagtcccaggtacagcaaacaatcaaggaaggcgcaacctgtctttttggcggcaagcggtttaatgcaacttactttgaacctaccttgctcgcaaacgtcactcccgatatggcgattgccagggaaatggaagtatttgggcctgtattccccatcatcgggttcgatacggcagaccaggcgatcgagatcgccaacgcatctccttacggcttatcgagcggcgttatgtcgcctgattttcccacggctttaaaagttgccatggcaatggaagcaggtacatgcgtgatcaacggctgcggcaattaccgtagttcccatttggcctttggcggttacaaaatgacaggtatcggccgtgaaggcgtaacgcaaaccttggatgagtatacccaaaccaagagcatcgcgttaaagcagttattgaaatagagggaaagcgccgttctgcctcatccttcatttcgtatgaggcagaacggtatgaaaggtgaacacagtgaaagcagcaaattatccctgtaaagggaaaatagagatgatcgaaaaagatattcccgcaattggtgaaggcgaagcgctcgtacaggtgaaatatgccggaatttgcggcagcgacatacatgtatggaaaggaatgcatgcaacggcaacctatccgcgtgtgcccggccatgaattttccggtgtgctcgcagaagcaaacggtactctgcgcgatggcttgaaaatcggcgatccggtcgtcgtacagccattttggtcctgcggcatgtgtgaaccctgcctcaccggcagggataatgtctgcaaaggccttaaagtattcggcgtacatgaggatggctgttttgccgagtatgtccgtgttccgctcaaaaaagtgtaccgtctgccggaccaggtcccattgaagctcggtgcattgacggagccgttagccgtcgcagtacatgacgtatgtaaaagcggactgcaggtcgggcagaaggccctgatcattggcggcggccctatcggcatcctgattgccatggtcgcagcttatgcgggtgcaacctcctatatcagcgaaatcaatgattttcgcattgattttatacgttcacttggtatgaatgtcatcagccccgccaaggaagacctggataaaaaagctatggaactgaccaacggcaaggggttcgacgtcgtgtttgaagtgtcgggcagccgtccgggtatagaagctatgacacggcttgtcaaaattgcaggcacagtcatggtcatcggcattcccggtaagccgcagcctcttgacgaaggcgctgtttttgccaaagaactaaagattcggggtgtgcggatacactcgcaaacgaattttgaaaaggcgctatccatactggaatcgggccagctcaacgaaaatctggagaaactcattactaaagtatttccgctcgacggctgtatagaagcaatggaataccaggtaaatgatccacatcactttaaagtcgttctcgcgatggataacgtaaggtggcgttcctaaagacccttttgtgaggtgaaaaatatgaaccatctatttgaaccagtgcatctaaagcatttgactctgaagaacaggtttgcgcgctcttccaccaacgtaaagctggtagaagaggacggcgcgcccaccacagcgcaggtagaactattccgcagtctgtccgcgggagggataggactgattttttcggggcacctgtatgtatcctcgccgcacggaaaggatggccctggacagaccggtatttacagcgatcaccttatccctgcactaacgcgaatggtacatgcgggacaggaaaacggctgcaaagtgattgcgcagcttagccatgcaggcggcaaatcgcgtattggcggaactcctgtagcaccgtcgtccggagactatctgggcgacggtgttttaagccgggcgctttctttagaaaaaatatgccgaatcgtgcaggactttacagcagcggccgtgcgtgcacagaaagcaggatttgacggcatccaggtacattgcgcacacggctatcttctgtccgaatttatcgatcccgcatggaaccaccgccaggaccggtatggcggttctgttgcgcgtaggttttccctggcggaagaaatcattgtctcaatcaggcaggtatgcggtgccgattatccgatattcgtaaaattgaacagtgataccgtgcaggacgacattgcttatgagacggatctggcttatatgatgcagcgcttcgatacgcttagcatagaagccgtcgaactcagtggaacttccatgtctccgcctggcgtaccaaaatcgccttatttcttaaaacgcgcaaaaaaaatgcgcatcctttttaaaacgcctgtcatcctcgtaggtggcttccataccttatacgggatgcaggatgctgtctccgccggcattgatatgatttccttttgcaggccgttgatcgctgagccggatcttgtataccggctggaaaaagggcaggccgaggtagcatgtatccgttgcaacggttgttttgcggatgggatacgttgtatccggaatccccgataaggaacaaaaggaactactttcgtttatgcgaagcggttccttttttgattaaaaatatccgccgctcagctatggatctgaacggcggacgcaagaaggattatctgtacgctggttttaaccctttctgttgattgcttttttcgcgctccggacgatatcccttgcagtcaagccaaatttctcctgtaggtaagccacgttcccgacttccccaaaatgatcctgaatccctacccgctccaagggaaccggacatgtctcccccaatacttcagcggctgcgcttccaagcccgttgattacgttatggttttctgccgtcacgatcgctcctgtcttctctgccgctgccgtgagcgcttctttatccaccggcttcaaggtaaacatattcagtactgctgcggaaactccttcttctgccagcttctgcgccgcccgtatcgcttctatcaccatgatccccgaagcaacaatcgtcacgtccgtccccggcaggacttcggcagccttgccgatttcaaattttgaaccgtactcatagattcctatggcatttttccgcgacaaccggatataatagactccctcttttgtttccgtctgcaggagcatatcggcgagcatcacgctgtccgtcggctcgagcacggtaacgcccggtattccgcgcataatacccatatcctcgaacggcatatgcgttgcgccgttgaaagccgcagtgatccccgggtcgctgccgacgatacgcacgtttgctttggcaaatgcacaggatacgaatacctggtccgctaccctgcgcgttgcgaaggtcccaaaggtatgcgcataagggattttccccatggaagaaagccctgcggccactccgatcatattggcctcctgaattccgcaattaaacgtccgttccggatatttttttgcaaaccccactgtaccgatcgaattcatcaggtccgcatccattaccacaatatcgttattatgttcggccatatccataagcactttggcgtatgcgtccttcattgccgttttttcttccacaaattcatttttcaccatatattgtctcataactcttacctccgccctatttaccgcttctgatggcttctattgcactgtcgacctgctccgccgaaaaacgcatgtgatgattatataactcgccttccgcaaaattacatcccttgcctttgtgcgtatgcagaataaccatattcggtttttgactgtcggcatgatggatggcgtcgcttatttccgtaacgttgtgcccgttgcattcaataacattccagccaaaatccataaatttcttcgccaggtccccgaggtcgcagatgtcttttacatatccatccaattgttgcttgttataatcgacaaaagcgatcaggttagctattttaaactgcgccgcaaaaagagcgccttcccagacctgtccttcgtcgcactcgccgtcccccaagatcaaaaaagtacgcgcgggaatcttatccatcttttgtgccagcgcgatcccgatcgcggtagacattccttgtccaagtgatccggtactcatatccacgcccggcgtccggttcctgtcacagtggctgggcagccttgtacctccggtgttgatggttgccaattcttgtaccggaaaaaagcctttcaatgcaagcgcggcataaagagacggtcctgcatgtcctttagacaataccaattggtctcggtcgcgctttttcgcgttcttcggatcaattttcatttccccgccatacagcaccgccaacaagtctgcaatagacattgcgcctcctacatgcccaaatccgaggcagcgcaaggatttcaaagcttcgattcggatttcttttgcaaattcttttgttctcttttcccattcttcattcatttttcttccctcacttgtctttgattgactggatttttatccgtttcctgccttacgggatcaaaaaaatcttatacccctctttatttatgaacatgtcaaatgctttttcccattccgtaagcggcagccgtgcgctgatcaatttttccagttcacctaactttccctgtgccgcaagttgcaatagtatctcccatgatgttcgttccgtcgcataactcacagtcaactccaattctttatataagattgtgtccatatccaccggtatttttttaccaaaaagtcctacctgcgcaagattcccctttttcttcagcatagaaatacaggtgtccagcgaagctgccgcccctgcacattcatatgcgacgtccacaccgtccggcgtgacctcgtttattattttttgtaattcttccgggttttgcgcaactgcatccgcccccagctcaagccctgtggatagtctttcggcgtcctgcggcgttcctgataatattacatacgccccttgcatttttgcaacgagcatagtaagctgtcccattgtccccggccctgaaaccaaagcaatgtctcctgctttcacgcgcgactgctcgactaccgcacgaatgacgcaagcaagaggctctgcaagcgccatcatatccgtgcccgctatcgcatccggaagcttaaaagccagttttgccggaatgaccagatactccgccattgagccgtcaatacctgaaccgatcgagcggcgttcgttacacagcatcaaaagcccctgcctgcagtatcggcaatggccgcaggtcacagctgcagtcatggatatgacctggtccccgatcccaaagccttctacatcgtttcccaccgcttcaatgattcccgtatattcatgccccaaggtcaccggcggattacactggtattcgtcgttcataagatggatatccgtcccgcatatccccgcagcaatcacttttaccagaagctcatttttgcctgcaacaggtttttctacctcctgtatgcccagcccttcgcgtccttttccagatttaaccaatgctttcatacggttctccttatgctttcgtatagtcatagaaacctttgcctgcttttttccccaataacccgccgcgcaccatttttttcagtaaagggtgcggacggtatttatcttcgcccagctcactatgcagtacctccatgattgccagacaaatatcaagtccgataaaatcccccaacgcgagcggtcccatcggatggttcgcacccagctgcatcgctttgtcgatgtcctgcgcacttgccacgccttccgccaaaacccccaccgcctcattgatcatggggatcaaaatcctgttgaccacaaagcctgcttcctcgtgtacctccaccggtgttttattgagttctactacgatttctttaatacgcccgatcatctctttgggtgtattcaatcccgctattacttcaacgagcttcatcacaggcgccgggttaaaaaaatgcatccctgcaacaggacgtttaaggccctgccccaactctgtgatagaaagggacgatgtgttggtggtaaacagggtatcttctctgcaaatatcctgtagtttcagaaacagcgctctcttagcccccatgctttccaccgccgcttctatgatcaaatcacaatcccctgcttgctcgcaggttcccgttttgatcttttcaaggatttgttttgcagcctcgccacccaattttccttttgaaacaagcttcgccacgtttttttctattttcgtcttaccggcccttgcaatctcatcagtcacatcacataaaacaaccgaatagcaatctttttttgcaacagcctgcgcgatgcctgtccccatcgtccctgctcctatcactccaactatcattagtacatacctcgcttattggccccgaaatccttggggcttgtcccgttttacaaatgcatgcatagcgtttttttgatccatggtttcaaaacatttcccaaatagaatcgtttcctctgcaagtccgtttttcaggtcttggtactggatcctgtttatggctttcttgctcccttgtattgcaaatggagcattttgtgcgattctaacagccatctccatcgctttttccatcaattcttcttgcgcgtatacctcgctcacaagaccgatcgctttcgcttcacatgcattgatttttcccgcggtatagatcatttcctttgctttttctataccgacggccctaaccaaacgctgcgttcctccaaatcccggaatgatgccaagactggcctccggttgcgaaaaaacagctgtttccgaagcaagacggatatcacagcacaacgcaagttcacacccgccgcccaaggcatatccgttgattgccgcaatcacgggcacttgcagattttcgagccgttcaaaaatctctttgcctttttgcgcataaaattcggcttcttcacgcatgtatccctgcatctcgctgatatccgctcccgatacaaaggcctttttccctgcccccgtcaataccgccgcacgaatatcgcccgtatcctcgattacagtaatgattttgccaagttcgtccaataccttactgttgagtgcattgagtgcctcgcgcctgtctatggtgattacacccgcttgccctgctttctcaaatttcacaaaatccatcgtttctccccgcttcggcctacgcccgttctacaatcgtggttacgcccatacctcctccgacacataacgtagccaacccccgttttacgtttcttctatccatctcgtgaagcaaactcaccagaatacgacatccagaggccccgaccggatgcccaagcgcgatcgctcccccgtttacattgacaatatctccgttccattccagtatttttcccaccgcaatggcttgcgctgcaaacgcttcattcgcttcgatcaggtcgatatctcctatgcggcaaccagctttttcaagcgctttttttgtgctgtatgccgggccgatccccatgacctccggtgctacgccaacagacgcccctgcaatataagtcgccatcggttcaacgcccagcgccgccgcttttcgtccgctcatcaaaacaactgccgcggccccgtcgttgatgcctgaagcattggccgccgttaccgtaccattttccataaaagccggcctcaacttctccagtttttccatcgtggtatcttcccgtggaaattcatcccgttcaaaaatgatcgtttcttttttcctttttaccgggacgcctataatttcgctttcaaaccttccgcctttttgcgcagccgtacatttcaattggctctgtaatgcgaagctatcctgcatgtcccgtgtaataccgtattttttcgccacgttttctgccgttatgcccatatggtaatggttaaaagcatccgtcaacgcatcgtttatcatggtatccgtaaactgcccgtttcccatacggtaaccaaaacgtgcactttccaatgtgtagggcgcctgcgacatattttccataccgcctgctacgataacgtctgcctctcccgcggcaatcattgccgcagccatattaacgcatttcaaaccggaaccgcatacattgtttagcgtaagcgcaggaacagtctccggaattcctgcggcaaccgatgcttgccgcgccacattttgtcccaggccagcctgcaaaacgcaacccatatatacctcgtctacctgatcaccgcaaagatttgcccgcttgagcgcttctgcaataacggcctttccaagcataacagccggtacatttgttaatgtcccgccaaatttcccaatcgccgttcgcaccgcgcctgctattataatggaatctttcatagcatctctgttcctttattattattttgtagatagctaatgtactgttgatacgaaaatcgcaccgaattgaataataaatcttagatcgtacacttaatatatcatataaata

SEQ ID NO: 23 - DNA, 14408 bp, Christensenella sp.
ggggtcacccgccgcttcccccccccaaccaagtaaaaacaaccaggcacggcgacgccccaagctacacatttcaacccagcccccctaccccccccccccccccccgcgctggctcggctgggtttgctatttatccgacaaacttgaatttattttaagttatcacgttttaccttcttaagccttactatcattaccataggaatttctttgttggttttgaaacattcttcataaaatccatcaatgacaaatccagctctaaaacaaaggttaaaaatatcttgtatggaacgatgataataaatctgctctttcggttgcccttcaatcgctatatcatagtaactgtgcggtgtcatatatttttcagtcaacgtgacaaaacaagggtgttgcgttgcaaagacaaaaattccgctttcctgcaacagttcataaacagccataagaagtggttcaatatccgtaatatccataattgccatattagaaactgctttcgtaaaggctcgatttctttttaattctaatatactttttctatcggtcgcatccgccacacaaaattcaatttgttttgcatattgtgattgccgtcttttagccaattctatcatttttttgctgtaatcaaaagcgacaactgaagcgcctctttgtgcaagatacgaagaataatttccattgccacacgcaatatccaaaatgtaatccgcaggattaggagatagaagttccgttactttgggacgcactacctctctgtgaaattcattagattcgtcacccattgcattatcccaaaattgtgcgttctcctcccagatttttttactttcctctgttcccatgttctctccccatcccaaaatttgcttttttacttccattaaatcttccttactatattccattcttaccctccataacttctgattgttgccgtcttgactattatgtatcttttctttccaaaatggtataggcttttatttttgtaatgctgcaaaacttttgctttcctgttgtaatatccgtctgttcctggttcaaaatagttcctcatctctgatactgattttattaatgatatttcgcaatagccagcaatgaacgcttgtattgcgcaagacgttacattaccttctgaaacatatggcgcaccttgtccaggcggctgtttggacgacggggctggatgactggctcgccgacagtggcctgataccctttcagttccgtcaggcacacgctccgcccgttggtgtaaaaggccaaatcagtacggtatgcctgtatgcaacgggcgggaatctcgccagtaaagacaacttcatccttttttatctgggccgtttcgatggtggcacagtatttcggcgcatcatgataagccctggaaaggtattcctggggcgcatagagggtgaaggagagataaggttccagcaactgcgtccctgatttcttcaatgcctgttccaatacaatcggggccaatgagcggaagtccgccggcgtactgaccgggctatagtaaagcccgtattcaaaacaaatcttacagtccgttacgttccagccacacaagccttgctccaaaccgtaacggataccatccatgacagcgttttgaaaactctggttcaggtatcccagggaaacccggctcttgtattttacaccggagccaagcgggagcggtgtaacagacagtccgatagatgcccaaaacgggttaggcggcacctcgatatggatggtgtggctggccactttgagcggccgttctaaataaatgacggtgggttccttcactgctgtttcaatcttgtatttttccgtcagcaaagcggaaacaacctccaactgcatccgacccaaaaaagaaagaatgatctcatgggtggtggaatccacctcgtagtgcaaaagcgggtcagtatccgcaatttgcgtaagagcgtccagcaaccgatctctttgctctgccgtttttggcgtaatcgtcgtccgcagcatagggaagggaacatcactccacatttcacgaggaagttgggttttgtcccccaatatatcgtttaatctcaagctgtcgctgggaaggatgacaatttcgcccttatgggcggtatctgtccgaacaatctcccctttggatggaatacgcatctctgtgattttcagcttttctctcccggccagggccaccgtatcccgcagacgcagcgttccgctgtatagccgcagatagacaagccgctggccgcaatctgtatactccaccttaaaaactctaccgcacagggcggcgctcccctgttccttggtcggttggaacagccctatcaccgcatccatcaactgttgaatgccaaggccgtttttggcgctgccatgatagaccgggagcagggaggcgtcttgaactcgccgctgttcttcttgcgcaagttctttctgactgattgattctcctgcgatatactttgccaataactcatcgttattttcgatgaccgaatcccacacctctgcactagtgttttctgtcagagttattttcgaggacagcgacactgtctgcttgatgataatatcagcggagagcttatcccgaacagactgatatacgccctccaaatcaatgccaacctggtcgatcttgttgataaagataatggtggggatgttcaatttccgtagggcatggaacagaacacgggtctgggcctgcacgccatctttagcggagagtaccaagatggccccgtccaaaacggccagagagcggtatacctctgccaagaaatccatgtggccgggagtatccacaatgttgactttacaactgtgccactggaaagaagtgactgccgtttgaatggtaattccacgctgccgctccaaaaacatagtgtccgttctcgttgtccctttttcgacgcttcccggctctgaaatggttccgctggcatacagcaggcgttctgtcagtgtcgtcttgcccgcatctacatgggcaagaatcccgatattgataatgttcatgtctatcctccatacaaggcccaaaagggcgcaaaaatccccagcagcaaatacttttaccgctggggatcatgacttcggatacataaaaacgcattcagctaacatgagccgttatccgtcacgatatttgataaaaaggcaaaagcattcttaaattgggtacaaaaaccaagcccctgcaaggggcaattatttttgtgcccattatcaaattttatttaagaataccttgccgcatgttgaatagactcctcaaatcaggatggcaacagtatagcatagcacactctaaaatgcaagaagtttttacccgctgtcccaaataaatcaggagggcattcaccaggacaccctccgatttggggcctcatgcgcaaataatttctgtgtccacgatttccgccgcacacgcccggatattgttagtccctctgcaactcataccacagaccgttgccctcgtcaaagatgtacttttccatgaaattacctccattttttgtgattatcgtgcgcctatcctcatttttgaccttgcgccccatttccgctccttttcgacctgttcctgctggtaagctgcctccagtatcctgtccgcctgttccgggccaatggcccgtctgacccgctcatagtccctgacctgtccttttaggctgtccctctcggcacagacctcataaattctagctgacagagagccgttcttactgacctcacgatcataggcgatctgcaaccgctcaaacctgctcttgagatcgaagtaggcccggtagaccgagcgcagcaccttgacaatcttctcccaaaggggcttgaccttcttctctcggtaagacttggccgattccagcggccccgcctccggcagcgtccgctccgggtcttcggagaagtctgctgccagcttctccatgcccttgagtaagggagccacatcgtccagtttggccctagcctgggccgctttcttctcggctgctgccgcctctttattctttttgtcggcctcgacctgggccagcgccgacgcctcttgaagctgtgcaagccgttcctgctcacgctccgtcttgaactgcgtaactgtcaaatgctcctcggaactgccacgttccccacgctctatatcgtcataaccagcggagcgcatatgctcaaagaaatcatcttgcaagatactgtacgactttcgcagaacgggctttcctttagctgtgcgcagcggttccccggtggtttcgtccagaatgggcttggacgtccacttcttgctcatgctcacctgcatgatcgtttccttgaccttgcccaccagggacttgtccttgcaccgctttgtccagcgtatctccttctccactaccgggatataaaccacatggaggtggtagtggtacacgtcctctcctagcacctcagacatggcccggttgcgctcgtcggcgtgcatgatcgccgacaaaatatactgctctccgcccacgattttgattgcggctttgtatgcttcggtgtaaaattgttttgcaaagtcatagccgccgtggttgtagaagtaagcggagtttacgtcaaagaccagctcaccatatcgaaaggcatcctccttgataccacgagtggaaatcacgccatcagcctccattcgagcaaacatctctcgatacccggcagacggggttttgaaatggacattgagcggcgtccgctccagtacaatgtcctgattgacataggaatccttctcacgctcgttgtgctgctgggtgttaccgatcttggtttcggtcagcctcatatttcttgcgttggtacggtcaataccgtcacctctcgccataggcaaaaatcctcctgtttcagacgtcgggttgttgaaagaggacgggggttcgggggagacacttcctgcgggaagtgtaataacccactatgacactttcatcccttcggtctgcaaagtgccgtgggctctcccgagggggtatgggggctttgcccccgccgtctgcggacggctcccccagcagggctgccctttgaaaagggcaccctgcaccccgtgacagccgtgacgaccgtgacgatgtttcagacaccgcccccgccctcaaaaaagccgtcacagccgtcacggtcgtcacgcctggggcggttccagcgtcaggctgatacttctcccggcgtggctcctgctgttctcatagcggatgtggtagtctgtcagtagtttcccggcccggacattcagccgcatcgccagtgcgttgggcttcatgtcggtctggagcgccgctgccagctccgtggccgtaccgccccaggtcggcctctccgccgtcacaagggtgactatggcctccagtaccgggtcgggcggttctatccactgctctgcctccatccgttccagcgtccatgtcagccgttccttgtccttggtgagatagaatcgctggtcttgctggtcacgccccaccacatccagggtggcggtgccgtccgtccgtttctccttctgaagaagaaaggctccgtccgctgcccccgccagtccgttggtgccggagatcatatcgaacttatcatcggcctgttgtttccgggtatgatgtaccagcaggaggcagacgccgcaatcatcggcaaaacgttttaatttcccaaccacctcgtaatcgttggcatagctgtacttatccccaccagcctcccggattttctggagggtgtcaatgataatcagcttggtgtccgggtgttcctgcacaaatcgctttagctgttcctccaatccgacgccgacctgcttggcgtggattgcaaagagaaggtcggtggtggcctccatgccgaacatccggtaaaggcgctcctgcaagcgacggtgatcgtcctccagcgccagatagaggacagtccccttgtgaacgggatagtcccacagagggaggccggtgctgacatggtaggcaagctgggccatcaggaacgacttgcccaccttgggcgctcccgcaaagaggtacgtcccagggtagagcagaccgtcaatgacgggcggtctgctctggtagatgttctggtaaaggtcgttcatggaaactgtgtggaggtaggccgggtcgttcatgcgccgcatatcccggagcatttcctctaaatctttctcttgggggttgttttcagccgtttcctctgctatactttgggtagttgtttgagaattgggctgttccccgtctgcgccaacagacggaaccgggacagtccttttcgtttctctggaatccatcaatctatcaatcctccttcatgccgcccagcgtcactgagataaggtcaatggtggcgagaagttcatcccccacgtcgcccccggcctcaatgcgccgcagttcccccaggacggcggcgagttggtcacgcagggccttgtagaccctgggattgccctgcaccaccacggcccggtctaagagccgccgggtgatgtagtcctgcttggtcagcccggagaggcggacggcaatctcaatctgttcgttttcctccggggacacccggaacgctatggttttgcttctccatcggttgtggttgtcgaggttcttcgcagacatgatttaagccccctttcgctccatgtccagcttgtccgccatctccgcctgccgggtggggaacaggtgggcgtagcggtaggtgatgtcgatgctttcatgccccacccggtcagcgattgccagggccgtaaagcccatgtcaatcagcagggaaatgtggctgtgtcggaggtcgtgaatcctgatccgcttgacccccgcctctttcgctcccctgtccatctcccggtgaaggtaggatttcgtcacggggaaaatgcggtctgtcggctttgcggcatacaggctcttgatgtagtcctccatttcttcacagaggaaggcgggcatttgaatgacccggttgctcttggcggtcttggggtcggtgactacatcctggcccttgatacgctgataggattttgagatggaaaccgtctgcttctcaaagtcgaagtccccaggggtgagggccagcaattccccctcccggataccgcaccagtagagcatttcaaaggcatagtaggagaggggcttgtccatcatagcgtcagcgaatttcagatactccgctttcgtccaaaacagcatttcccggcccttggccttgcccatgttgcccacctgggcggcggggttggctttcagcttgtagtgcttcaccgcatgattgaaaacggcgctcaactgattgtgcagcgttttcaagtaaacgggggagtagggcttgccgttcttgtcccggtagttgagcatttcactttgccacgccatgacttctttagaactaatctcgctcattttccgcttgccgaagtatggcaccagcttcttgtagaggatatgctctttcgtcccccaggtgttctccttgatacggcctttcatgtctgcggcgtagagcgccacgaaactctcaaaggtcatatccaggtcggcggtctgctgttgcaggaacgtccgttcccactccagcgcctcccgcttggtcttgaaaccccgtttcatcttcttttcctttttccctgtccagttctcaaagtaaaaggacgcataccatgtgcctttggccttgtctttgtatgctggcattttgttccctccttactgatttttccgcagcccatagaacttttcctcgaagtaattcctgctcacccgtccggggatggtgaggaaacccttctgcttcagttcctcgttcatctcccgcaccagcttgtaggcgtagggtttggagatacccagcaccccagccacttcctcggcccgtacaaatagttccttgctcacgttttcacctccttgcttctggttcgcaaaattgttaatgcccgcgttcttattatacattcgcatagttgttaatgtcaagagtttgtttcgcaattttgttaatttttctcttgcatatttcgcttatttgcgctatactatgttcaaaggcggtggaacatatgacagtaggagaaaaaatcaagaaaatccgaacttttcgaggcataacgcaaaaggaattggggctggctgtcggttttgaggaaaagggagcggataaccgtattgcccagtacgaaacgaattaccgtgttccgaaaagggaactgctggacaagattgcccaggcgcttcgggtagacttccagaacttctacacgctccgtcctggctgcgccgaggacttcatgcggacattcttctggctggacgaggacagccccggctccattcgcctgtttcagcttgtccgcaatcccggcaagacgggagcctccgatgataccgccgtccgctacaacgacacggacgactggcccgctcaacctcccgtgggcatttacttcaactatgggctggtagatgagttcatgcgggaatggctcttgcgccagcaggaacttcacgctggggaaatcaccagggaagaatactttgaatggaaaatcaactggccgtgtacctgtgacgacagcaaacggtttgactactatgttccttggagaaaagaaaaataggacaagcaaagccgccctgctgaatttgtcgttcagcagggcggcttgcttgccctttgcaatcattctcttgtgtggccgggttgaaacgaatagtatcaatccagtatcacaaggcagattaacaggtcaaaaaccctgtattcatgcgggtttgagccgttttgacggtcattcccactcgatcgtcgccggcggcttactcgtaatgtcataaacaatacggttgatgtggctaacctcgtttataatgcggtttgaaatcacacccagcacgtcatacgggatgcgtgcccagtccgctgtcattgcatccacgcttgtaacgccgcgcagggctaccgtataatcgtacgtccgctcgtcgcccatcacgcccacggagcgcatgtcggtaagcaccgcgaaatactgccagattttttcgtccagttccgctttcgcaatttcgtcacggaagatgaagtccacgtcgcgcagcaggtcgagcttttctttcgtgatctcgccaatgacgcggatcgcaaggcccggccccgggaacggctgccgccataccatgtgacgcggcaggccaagttcttctcccaactcgcgcacttcgtccttgaacagttcacgcagcggctcgatgatctcctcaaaatccacatgatccggcaaaccgccaacgttatgatgactcttgatcagcgcagcatcgcctacgccgctttccacaacatcaggataaatcgttccctgcgccaggaaatgaactttcccaatcttcttcgcttcttcctcaaatacgcgaataaattcctcgccgatgattttgcgctttttttccggctccgtaacgcccgcgagtttttccaagaaacgctgttccgctttcacatgcacaagattcatatcgaattgctttttaaatacattttcaacctcttccggctcatatttacgcataaggccggtatccacaaacacgcatgtcagatttttgccgatggccttatgcagcagcacagcgcaaacagagctatctacgccgcctgataacgccagcagaacctttttgtcccccaccttctcccgaattgcttcgatcgactgttttgcataatcgttcatatcccaatctccttttgcaccgcatatatcaaataaaaagtgctccaatatggtttgtccgtttgttgtgtgctgcacttccggatgaaactgcacgccataaattttttgtgtcttatttccaaaagccgctactggacaggattccgtttttgccagtatctcaaatccgtccggcgccttatcaatataatccatatggctcatccagcagacggactctgcctccatctcctgaagcaggagattcgacgtatcgtatttgatattcgtttttccgtattctcctgccggagccgacgccacatgcccgcccagcttcatggaaagaagctgactgccatagcatatccccaaaatcggtattccaagtttcaggatttcttcatcgcagacaggcgcgccttcttcatacacacttttggggccgcccgtaaaaataataccaatcggctccttctctttgatcgtttttgcatctgtctggtacggcaacagttcagcatagacatgtgcctcgcgcaccctgcgtgcaatcaactggttatactgtccgccaaaatccagtacaataattgtttccctcatctatttgcattcctccaatgaatgaccctcttcacaaaatatgacctccgttacgtaaggccgttctgtcttcaatagcttgttttttatatcctgccttacttccccgtcaaacgattcttcggaccacaccaaggccttttgtccatccaggcatacgcgcattcccctgcgcgtgtaccggcggatatatttttccgcagcttcgatgtaatcaagcccgtcgaccgcaacaggcaatccctccgaaaaacggcacgcaaggcaatgattggcaggccttatataataggctctgccgatcgctttcagcatttcctcaacatccggtcttataaaccccaagtccgcatacggacttatgatttgtatctcctgtatcccttgctgaagcaacaagcagccgtctttccctgtctccgccgttttcccatcaaaaatcactgagctgccgatgcttttagcaacctgcgatagccgctgcgatactcttcccgcgcatgccttgcatcgcgccgccctgccagcccctgtgagctgtggcatatccatcaaatcaggcatcgaaatacgttcgttgcgtattttgggataatcgtcaagcacttcatgtacgcagtacagttcttcctgtgtaaaaaaaggcgtatttgcagtcagcaccactccgttttttccctgcgcttcatacaaagcgcaaacgaggagcgcggataaggtcccaccggaaaacgcgactgccgcgtccggatatccatccatatatgcgaccagccgactgaaatccttttgtgcattatccatttattttgcgctgtaattcggcgcttctttcgtaatattgatatcgtgcggatgactttccagtaatccggcacctgtaatctgtatgaactccgcatttttctgcagtgcttctatattttttgcgccgcaatagcccatacctgatttaaggccgccgaccatctggtatgtcgtctcggcaagaggccctttgaacggtacgcggccttcaacgccttcgggcaccagcttctgcgttccctcctggaaataacggtccgcgctgccctgctgcatcgcagatacggaacccatgccgcgatacaccttaaagctccgtccctgatagatttccatttcgccgggactctcctttgtacctgcgaacaagctgccaatcatgaccgccgccgcaccgcccgcgatcgccttcgtgatatctccgctatatttgatgccgccgtccgcgatgatcttggcgccgctcttcgcagcttcctccgcacattccatcactgccgaaagctgcggaacgccgatccctgccactacgcgcgtcgtacaaatcgaacccgggccgatccccaccttaacgcagcttgcgcctgcggagatcaggtcatgtaccgcctctttggtcgcacagttacccgcgataatatcgagatcgggaaactggttgcgcaccgcttccacgacgttgagcacattttgctggtgtccatgtgccgtatcaatcgcgacaacgtctacctttgccgctacgagcgccgctacgcgttccagcgttccttttccagtaccgactgcgccaccgaccaaaagccgtcctccgctgtcctttgcagacatcggatactggatcgtcttttcaatatccttgatggtaatcaagcccatgagttttccgttattatccaccaacggaagcttttctattttatactttctgagaatcacctgcgcttcgtcaagggtcgtgccgatcggggccgtaatcaggtggtcctttgtcattacctcgcttactttacgtgtataatccgtttcaaaacgcatatcacgattggtaatgatgccgacaagttttccgtccggctctacaatcggaacgccggatattttataacgccccatcaatttgtctgcatccgcaacgctatgctcgggcgaaagaaaaaacggatccgtaataacgccatgctcgcttctctttaccttatcgacgttctccgcctgctgctcgatcgacatgtttttgtggataatgcccatcccgccttcacgcgcaatcgcgatagcaagaccgctttccgtaacggtatccattgcggcgctcataatcggtatgttcagcttgatcttcggagtcaggtaagtggatacatccacttcattcggtactacgtcgctctttttgggtttcagcagcacgtcgtcaaatgttagtccctgcgtaatcttcataaacatttcttcctttcttcgatgcgtcaattttaattattttatactatgcttcagcataataatatacacggcagatgacaaacggtttaatatcttctgtatgctctcatttgcgtatgcgtcaagccctgctgcaatgcatatacgctccgtctgtcttactttggttctgaggatgttcagcaccgaagttatcctatcccaatcttcaccgggaaaaatgtgcttcgtttgcagatacttctgtggatggcaggaatactcccgtagctcctccagcgacaaacccaggatcgtttcgatcttaacaggctgtgaacacgcctccgcgctcataaccttctgtataatgcagacgatatcttttaaatcacacgcaacggtttgctcctgcctttctttagcaaaagccaatgcatcgactgcgtaagcaagcaaactgtctatttctccgcgcagcatgatctgcggatcgtccttacgtgctgtttcgcttccatataaacatgtcgtaggctcagaatacttcattttcaggctatcttccttatcaaaaaaccgcatggcatgattatgcttgcggcttctcctctttcgtttcctcgtgctgctctgtttccagcgcttcagcatccatcttctcgagcatctctatgtgttcgcgcttcataacaaaccagttgatgcagccaatgacaaaggacaccaccaaaacaagcactgcacccgtaaacattctttccgcaaacaaaatcgcggcaacggcgagcagcgcagaaatcgcgtacagcaacaataccgattgtttctggttcatgcccatatccaccagcctgtggtgcaaatgcttccggtctgcatggaacggactttgtcctttaaacagtctgcgtatgattgcaaataaagtatcaaagattggtaagcccaatacgaggaacggaatgacgaatgatacgaccgcattcactttgaaaaatccctggatggaaataacggaaagcacaaaccctaagaaagtcgccccaacgtctcccataaatatcttggctgggttcaagttataaggcaaaaatccaaggcacgatcctgccagtacggcggcaatcactgtgactgtcggatttcctgcagaaagcaacgacacagccaaaagcgccagtgaagagatcgctgaaatgccgcatgcaagcccgtcaagtccgtcgatcaaattgatcgtattcgtaatggctacgatccacaatacggtaatgggtatcgcccaattgccaaagtaaatgatttggtcaaacagggtgatctgcttgatcacaataccggaaaaacatacgaccaaggcagcgccgatttggacaatcagcttaatccacgccttcaaatcgtaaatatcatcaaacatacccatgatcgtgatcataagcgctcctaaaagcaaccctacatatgtggaatccagaggaacaaacacaagcacgccaaatgcaaaagcaacaaatatagcaagcccccccattgtcggaatcggcttgctatgcattcttctattatcttttgggacatctacagcgccaaccttgattgacagcttacggacaagcggcgtcgtagtatacgtcatgaaaaacgtaaacagaagcgctatcactatcaacaaaccgtcgcgaagccccatacgaatcgtcatgtcctttctgtaaatatcagattaaatattacaagagcggcaaagcatgcgcgttgccgcccc

SEQ ID NO: 24 - DNA, 6947 bp, Christensenella sp.
cttccccttcgccgaacacaatttttgtcggtacctgaaattcgaatgcatacatctttttttcctcctgctatgtaaatgattgtttttttcaagtcatgcttccaataaatccgccatgtccatctcgacgacatattttttcaaccgcaagaacgattgtttttctcccatcagggtaacgctttcctgcttttccctcgggaggcggaagaccgtgtcttctatcgtccccctgttaagctgctgcctgaagcgcgacggactgcatttatatttatctgtaaacgccttgtaaaaatacctgtagtccgaatatccgctttccatacagatatcgatcatcttcttatccgttttggccatattttcgaccgccctgtccagtttaagcttattgacatattggcggaaggagatacccaggttctttttgataaaatgggataggtagtagatatccaatccctctttttcagcgattgcagtgagtgttatattattggaaaagttatcgttgatcatgtttacaattcgttttacccttccaaggctgcgattttcattgtcgcttgtccctgttgtttctattttgttgaattttatcagcaaggaaaaaaaactgtttatatagctcatacattccagttcatatcctctccccttgtaatacaggccaattgcaatcttgatgatatataccagtaatttgttatacaacgaatcgcttttgtcattatgccgcaccagccgctctgtgcacttcatcacattgatctcgtgataaaaagaatcaaacagcgatgtcggaatatggatcacaaggacgtcgctgccggttccgcgcagatcctttttgccgatatcatggaattcatcggcattgacgataaatatgtcgtctttgttaagctcatattcgttattttctacgccgaccatgaaactgtcgtccagtgcaagcataattttaatctgtttatgaaaatggaattgatttttatgtgtatcgacaaatctatttacactcgcagaaacattcagcttgttatgcatctgcacactgtcgactttcgtcccattgatcaaatccatcatcttatacacctataacgtaaccaacctccaggcgcacctcgctatttgcaatcagatagtgtgtatcgcctgcccctggaccgcctcggctgcttccaggacggcttcactgatcgtcggatgtgcatggatcgtgtttgcaatttcttcaacggtgcattcgctgctcatcgcgagggcaagctctgcgataatatccgtagcgcgcggtccgatcacgtgcgcccccagtatctcgccgaattcttctcccgccagtattttgaccataccgtccgcctcattcatagccagcgccttgccatttgctttgaacggaaacttgccgaccttgtaagcaattccttcttccctgagctgctcctcgcttttccccacgcaggcgatctccggctgcgtataaatgcaactgggcacaaggttcaaattgatttccgatttcttcccgttgattttttccgcaacataaattccctgtgcggacgctgcatgcgcaagcagtacttttccgtttacatcgccgatcgcatacacgccgtcaacattggtttcgaatgcatcgtttgtcttgatccttcccttttcggtctttatacctgcatgctttaatgccagggcttctgtttccggcttcctgccgacacagaccaaaactttgtcggccacgatctcccttttcgtcccctcgatctcatactcaattttctttttggttttataatcgctgatagcgcccacccgtgcgctcgtcacgatttccatatattccgatgcgtatttttggaattccgccgtgatctcctggtccaggtttggcagaatccttggaaatgcctccaaaacggtaacctttgtaccaaactttgcgtatacgctcccgatctccatgccgatcacaccgccgccgatgatgaccagttccttcggaagatcattgaaatcaagcgcttgcgtgcttgtgatcacattctttccgtctatcccgggaatcggcacaagcgagctcttcgagcccgaggcaatgatgatattctcggccgagatatccttggtatttccatcactcaattggatatgaagttttttcttatctgaaaaggacgcttccccgcgcagtacttctactttgcgttttgccaaaagatactcaacgccgcccaccaattgctgtacgacagcgtttttccttgcgtctacggctttggtatcgaccttataatcaaggacccttatgccgcattccgcgctgtttttgactgtatcgagcacctccgcgctgtgcagcagcgcctttgtcgggatacatcccctgttgaggcatgtacccccaaccttgtcccgttccacaaggatcgtcctttttccattcatcgcaagcttcaaagcagccacgtacccgccgggtccgccgccgatgacgattacatccgcatcttgtttttcttccggcagagcagatgcgctgtccttggcaactgcttttggctccggccctgcttcgcctgcctccatgatctctccaacgacagtccctaccggaaaagcctcgccctcttttgcaatgatcctcagtattccgtctgcaggagccgccatatcggctgtggccttatcgtattccatttcatatacgatatcgccttttttcacagcatcgccgtcgcttttacaccacctgacgacagtgccctccttcatagtctgtcccattcttctgatcgtaattttcttggccattttgtctcccccgctatatgaacatcaacgcaggcgcttcgatgatcttcttcaattcctgcaggaaatccgccgccggcgcgccgtctatcacacggtggtctgccgtcagactcaacaccatcatcggcctgatcacgatttctccattcctgaccaccgctttttcggccgtctttcctacgccaaggatcgcggattccggcggattgatgatcggcgtaaacatgtcgatccccttgcttcccaaattcgagatcgtaaacgaaccgcccgacatttcctctccgcccagctttcctgtgcgtgctttttctgccaattcctttgtatccgaagcgatctgccccggcgttttcttgtttgcattctttatgaccggaaccaaaagtccgttttctactgcgacagccatgccgatattgatatcggatttgtataggatcgtctcttcgttttccaggctcacattcacgttcggacatttttccagcgtttttgcaaccgctttgatgagcaggtcgttgatgctgacttttagcccctgcgcctcatattccaggttcaggtcccggcgcattgccaaaaagcgtgacatctcaacatccgttgaatatgtaacgacgggtatctggaaatagctttctttcatattcttggcgatcgccttgcgcataccgctcatcgggattctctcatcccctgcactgctttgcacggtagctgtttcctgccccgcatcgtctgcttcggaacgctgaatgaatgcttcgacatccgcagaagaaatacgcccgcttgcgccggatgccgttacctgcgcaaggtcgatccccagcttttttgccattttttttgcaagcgcagaggcgtttaccttttgaaccgtttgcacttcaggctcagttttcctgccgcccgttgcaaaacgctccaaatcctcttccgtgatccgtatgccgtcagacggaataaccccgcttagatcaatccccttttgccgggccaggcgtttcacacttgcagaagccttgtatccatcccccgcaacagttgcagccggagccgcagtttccacattttgcattttagcgggagttacgggggctttctctgcctggtcttctattgcttcacctgctccgtaaactttgccgaccactgttccgacagggaaagttccgccctcttcctctatggtttttaatattccgtcgatgggcgccaatatatctgtcgttgctttatcatattccatttcatataaaggttcgccggcctttacgctgtctccgtcgtttttcagccatctgataagcgttccctctttcattgtctgacccattctttgtatcgctacttttttgaccattgaatttctcccgcttcattgcttatttcatcattactgctatttcaaaattatcacttaaaaaatttccgatattgcttccacaatcttctcgctgctcggaacatatgcgtcttccagcaccggactatacggaaccggacaatccggtgccgtgatacggatgatgttctcttccagctcttcgatgcacgtttcagcgaccatggtcacgatctccgaagcgaaaccggacgtacgcgtatcttcctgtacgatcgccaagcgatgcgttttcttgatcgaatggaagagcgcctccttgtcgaaaggaacaagcgtccgcgcgtcgatcacttctgcgctgataccctttttctccagttcctccgccgcttccatcgccctgtgcaccatcatgctccatgcaatgatcgtgatatcattcccttccttcaggatattagctttcccaaagggcacataatagtccccgtccggcacttcgccttccaggctgttcagcagcgctttgtgctccaaatacaatacgggattgtcatcgcgaacagcctgctgcataagccctttggcatcagccggtgtcgccggacatacgaccttaaggccgggaatatgtgtaaacatcgattccagcatctgcgaatgctgggccgcaagacggctggtcgctccgcaagaagccctgattacaagcggcattttgcactttccgccaaacatatagcgcatttttgcgacctggttcatgatttcgtccattgcaacgcctgcaaagtcgatatacatcaattcaacgatcggacgcattcctgcggcggcagcgccgcagcccaggcctatgatcgccgtctcgctgatcggcgtatccagtaccctctccggtccgaattcctcaaacaatccttttgtctgtccaaagcagccgccgtatttccctacgtcctcgcctgcgacaaataccataggatcttttttcatttcatattccatgcccgttttcagcgcaacgccataaagcatcttttccatctcatttctcctttatacataaattttcagtagattccgacgattacgcatacacgtcttcggtcagggtcgatacgtccggatacgggctgttttccgcaaactccgtcgcttccgcaatttcgtcgtccacctttttctcgatttctgccagttccccttcggtcgctatcttttccttgatcagcaactctttgtatcgcgggatcgggtcctttttcagccattcttcatgctccttcttgtcgcgatagatgaattgcctctcgtcaggatcgccctcgaagtgtccgaaatgccgccatgtcttgaattcgagcagtgtcggtccttcaccctttcttgcacggtcgaccgctttttttgttgcttccatgaccgctaccacatcgttgccgtcggccgtctcgccggggataccgtatgcttttgcgcgatcggacagattcacaagtttggtcagcttcctctggctgcctgatatcccgtagaagttgttttccaggacgtagatgacaggcatattatatgccgcagccagcgtaatgctttcatggaacgtaccgcggttagaagcgccgtcgccaaagaagcaaacacttacctgccctttgccgaacgatttgcaggcatagcctgcgccaacggcgattggaagacccgcgccgacaataccattcgagccaagtattccaagatccatgtcacaaatatgcattgatcctcctttgcccttgcagtatccggtcgccttccccgccagctccgccatcatgagctttaagtcgccgccctttgcaatcaggtgtccatgtcccctgtgcgtactcgtaataaaatcgttgtcattcaaaatactacacacgcccgtagcaatcgcttcttcaccggcataaaggtgcgcaccgcccaaaagcaatccgtttgcataaagttcgcgcgctgcatactcaaaagcacgtatcgcaatcatattacgatagattttaagcatcgtttccttgtcttttttcattttaaaacctcctgataaaatgatgtttttatttatttgtttatgaaatgatcgatagactgatccaaattgtaaaagcaacattgttttacaattgtaaattaattttacttttattgaccttgatgtaacagtattaatgatatcgtgtaaggcaacatttatctttgttgtttttgcttttatttgatcatattttttgtccttataaaaaatatattgagaacttatcaaaattggatataacaaatagaagggacgttatcgccccttgctattaactctcacaatgtttcttcgaatgactgtaagccctgttgatgatgctttcaaaaattatttcgttaattttcgttacgatttattatatactatatttgcacaaataaaaaacccgttcatatagaacgggttttagttagaatccggcaactacctatcctcccacaccgttgccagtgcagtactttcggcgtttagaggcttaacttctgtgttcggaatgggaacaggtggatccctctagctatcgccaccggaaatggctccccaggttgggtttgaaccaacgacccttcggttaacagccgaatgctctaccgctgagctactgaggaatattcacttgtaatgtgcataagcacactcaaaactgtatagtaggtaggaaagacaaaggaatgtcttaagtca

SEQ ID NO: 25 - DNA, 5439 bp, Christensenella sp.
tgttgacatggggaaggtagtttggtattataaataagccgcaaaaaacgcggcgaaccttgaaaaaagcatacagtaccaagaacgaaaaggaaatgcttgaaaagcggagcctagatcaatgaatagttaaaaacattcgtgaggatgtaaagattttaattaagagtttgatcctggctcaggacgaacgctggcggcgtgcttaacacatgcaagtcgaacgaagttgctctttgtgaagccttcgggtggaactgtgagtatacttagtggcggacgggtgagtaacgcgtgagcaacctgccctgcaacgggggacaacagttggaaacgactgctaataccgcatgagaccacggtttcgcatggaactgaggtaaaaggatttattcgatgcaggatgggctcgcgtcccattagatagttggtgaggtaacggcccaccaagtcaacgatgggtagccgacctgagagggtgaacggccacactggaactgagacacggtccagactcctacgggaggcagcagtggggaatattgggcaatgggcgaaagcctgacccagcaacgccgcgtgagggaagaaggtcttcggattgtaaacctttgtcctatgggacgaaacaaatgacggtaccataggaggaagctccggctaactacgtgccagcagccgcggtaatacgtagggagcaagcgttgtccggaattactgggcgtaaagggtgcgtaggtggtcatgtaagtcagatgtgaaagaccggggcttaaccccggggttgcatttgaaactgtgtgacttgagtacaggagagggaagtggaattcctagtgtagcggtgaaatgcgtagatattaggaggaacaccagtggcgaaggcgactttctggactgtaactgacactgaggcacgaaagcgtggggagcaaacaggattagataccctggtagtccacgccgtaaacgatggatactaggtgtggggcccgatagggttccgtgccgaagcaaacgcattaagtatcccgcctggggagtacgatcgcaaggttgaaactcaaaggaattgacgggggcccgcacaagcagcggagcatgtggtttaattcgaagcaacgcgaagaaccttaccaaggcttgacatcctctgacgcatgtagagatacatgttcccttcggggcagagagacaggtggtgcatggttgtcgtcagctcgtgtcgtgagatgttgggttaagtcccgcaacgagcgcaacccttattgctagttgccagcatgtaaagatgggaactctagtgagaccgccggggacaactcggaggaaggtggggacgacgtcaaatcatcatgccccttatgtcttgggctacacacgtgctacaatggccggtacaaagggcagcgaccccgtaagggtaagcgaatctcaaaaagccggtcccagttcggattgtgggctgcaacccgcccacatgaagtcggagttgctagtaatcgcgaatcagcatgtcgcggtgaatgcgttcccgggccttgtacacaccgcccgtcacaccacggaagttgggagcacccgaagccagtggcttaaccgaaaggagagagctgtcgaaggtgagatcaatgactggggtgaagtcgtaacaaggtagccgtatcggaaggtgcggctggatcacctcctttctagggtgtaagaaacaaagaggcaaagcgaagtaggacattttcttttcgggtactgatgtttttaaagggaaaaagaacagcaaactgcataaaagccgtttgaagcgcatatacgggagtatatgtgatttaaaatgggggtgtagctcagctgggagagcacctgccttgcaagcagggggtcagcggttcgattccgctcatctccaccaagagtgggaagaaagcgggagacaccgaaggcagctaactgtaggtatgggctcatagctcagcaggttagagcacacgcctgataagcgtgaggtcggtggttcgagtccacttgagcccaccaaagcaatcgagagattgcggggcgggatccccaaaaactaaggaaggtgacgaccggaagcggctgcgcgagcaaagcgagcgcataagttatcttgtcggtggttcgagtccacttgagcccaccatgcgttttgtccgacgaggaaacgagtcgttgacaaaaggcacgcaagactttcccaagagccaagcctgtaagggcgaaggcgattggcagaaagttactgcgcaatgccctagggcagcgcgttgaagcacattgaaaactggatagtagaagaaaagacaaagagaagcgagaaaaagatatatcaaactaatctgaaaagaaaagggtaagatataatttcgttttaaagaatgtcttaggaaagaaagaaccaaagtagacgaaagatcaagctaacaagagcacagggtgaatgccttggcatcaagaaccgaagaaggacgtgtcaagctgcgaaaagctgcggggagttgcaagcaaacattgatccgcagatatccgaatgagggaactcagcgcgagtaaagtcgcgttaccatatactgaatacataggtatatggggggaacccggtgaactgaaacatctaagtagccggaggaaaggaaaacaaaagtgattctccaagtagcggcgagcgaacggggaagaggccaaaccggaagtcttcggacatccggggttgaggaccgacataggtgatctgacgaatatagtcgaatagcattggaaagtgcagccaaagagggtaacagccccgtagacgaaatacgagtcagcacagtcggcaccagagtaccacggggcacgtgaaaccccgtgggaagccgggaggaccaccttccaagcctaaatattccttgatgaccgatagcgaaatagtaccgtgagggaaaggtgaaaagcaccccgggaggggagtgaaagagaacctgaaaccctgtgcttacaagcagtgggagcactattagaaagtgtgaccacgtactttttgtagaacgggccagcgagttacggtatgcagcgaggttaagtgattcagtcacggagccgaagggagaccgagtcttaatagggcgaataagttgcatgctgtagacccgaaaccgggcgacctacccatgagcaggttgaagcggtggtaaaacaccgtggaggaccgaaccacacgtatgttgaaaaatgcggggatgacttgtgggtagcggagaaattccaatcgagctcggagatagctggttctcctcgaaatagctttagggctagcctcgagtgaagatatatgggggtagagcactgaatgggctaaggggcttcacggcttactgaaccttatcaaactccgaataccatatattacctactcgggagtcagacagtgtgagataagtttcattgtcaaaagggaaagagcccagatcatcaactaaggtcccaaagtgtaagttaagtggaaaaggatgtggaattgcagagacaactaggatgttggctcagaagcagccactcatttaaagagtgcgtaacagctcactagtcgagtgattgtgcgccgaaaatgtccggggctaaaacttaccaccgaagttatgggtgcacagtaatgtgcgcggtagaggagcatcgtatacgggcagaagctgtaccgagaggagcagtggactgtatacgagagagaatgctggcatgagtagcgagagtgaggtgagaatcctcaccgtcgaaagcctaaggtttcctggggaaggctcgtccgcccagggtaagtcgggacctaagccgaggacagtatcgtcgtaggcgatggacaacaggttgatattcctgtactgccgacaaagcgtttgaccgacgcagtgacacaggaggatagcagaagcgagctgatggtagagctcgtccaagcactgaggctggaaattagtgaagtacggtttccataaaggctgaggtgtgatggggacagaaaacaagtatggaagtctgtgaatccacactggcgagaaaagctgctagggagttttgtaggtacccgtaccgcaaaccgacacaggtaggcgaggagagaatcctaagacgatcgggagaagcattgttaaggaactcggcaaaatgactccgtaacttcgggataaggagtgcctagtaacataggtcgcagtgaataggcccaagcgactgtttagcaaaaacacaggtctgtgcgaaatcgagagatgaagtatacgggctgacgcctgcccagtgctggaaggttaaggggaattgttagcgtaagcgaagcaaggaacttaagccccagtgaacggcggccgtaactataacggtcctaaggtagcgaaattccttgtcgggtaagttccgacccgcacgaatggcgtaacgacttgggcactgtctcaacaatgtacccggcgaaattgtagtatgagtgaagatgctcattacccgcgataggacggaaagaccccgtagagctttactgcaacttggcattggattttggtattggatgtacaggataggtgggagactaagaagctaggacgccagtcttagcggagtcactgttgggataccacccttccaatactagggttctaacaaaaggccgtgaaccggcttttggacagtaccaggtgggcagtttgactggggcggtcgcctccgaaagagtaacggaggcgcccaaaggtttcctcagaatggtcggaaatcattcattagagtgcaaatgcataagggagcttgactgcgagagggacacctcgagcagggacgaaagtcgggattagtgatccggcggtatgagagtggaattgccgtcgctcaacggataaaagctacctcggggataacaggcttatctcccccaagagtccacatcgacggggaggtttggcacctcgatgtcggctcgtcgcatcctggggctgaagcaggtcccaagggtttggctgttcgccaattaaagcggcacgcgagctgggttcagaacgtcgtgagacagttcggtccctatccatcgtgggcgcaggaagtttgagtggagctgtccttagtacgagaggaccgggatggacgtaccaatggtgtaccagttgtcgtgccaacggcatggctgggtagctacgtacggacgggataaacgctgaaggcatctaagcgtgaagccccccacaagataagacttcccattccgtaaggaagtaaggccccttgtagactacaaggttgataggccggaggtgtaagtgcagtaatgtattaagctgaccggtactaataggccgagggcttgatcaacgatagttgattaaaaacagtctagaaacaactgacttaagacattcctttgtctttcctacctactatacagttttgagtgtgctt

SEQ ID NO: 26 - DNA, 3996 bp, Christensenella sp.
aagcacagaacagacagacaaaaggacaggccatgtgacctgtccttttttgtgccttctgttggtgcggttagatggataatcaataatcgaaccgttcgctgtttttgaccaccagttctgcctggcgtgcgtaggtatccttcaaaatagggtacagggagcggtatgtcccataatattcctcgtaaatttccacgttggtcgggtttggcgcaacctcgccggtaattttgataatggagcggcatgcatcctttaaggaagcgaaggcgccgcaaccaacggaagccatgagcgcgaccccgcaggctggcgcttcctcgatgctggtgctcaggatggaagcgttgaaaatatcggcctggatatgacgccacaaactgcttttggccccaccgcccgaagcgcggatctcattgacctcgatatcgtattcacgcaggatctcgagcgtatcgcgtaagctgaacgtaacgccttccatgacagaacggcaaagttcctcgcgcccatgccggtaagtgatgccaaagaaaacgcccgaggcattcggatcggaatatggcgtacgttcaccgttcaggtatggcaggaagcaaaggccttcgctgccgggcttggcgttttgcgcaagttcgctcatataattatatacatccttgccaagggcggccagttcttttttttctgtcggaaacatggaatcacgcagccatttgaaggaaccgcccgcgcctaatgtacatccgaaaaggcaccatttctcctgctggacatggcacatggaaagcgcggcgcgcgggagtttatccgcgatcggcgtatccactgcggcaaacacaacgccggaggcgccgatcgtggaagaaaccatgccggcctcgatcacgccattgcctacgccgccggcctgctggtccccgcagcccgcgacgacgggaatgccgcttttaagacccaattccgtggcgatgtcctgctgcaggtaacccgcgacatcacatgattccagcacccgttcgggtacgaccgatttatcgatattgcacatggaaaagagctcgtcggaccactcgcgtttgggaacgtcaaataaaaaggaaccggatgcgtctgtcacctctgtggaaatatctcctgtcattttgaaacgcaggtaatccttggaaaataaaaccttatagattttctcatagtcctccggcgtatgctgctgcatccacatcagtttgggcgcccaaaaaccgggcaggggatggttggccgtgattcccaaaaatgtatcggggcctatattttcttcgatccacgccttttccttggtggcgcgctggtcgagccagataatacagttgccgatggtatctaaattacggtcaaggcaagtggtggcgagcatttggccggtgatgccgatcgcttcgatttttttgcccgcgtcgcttgagtttacggcggtccgaaccgctctcttgcacgcataccaccattcgccggggtcttcctcggcgtaatggtatttgggcgtgatcatattatattcttcatatcccataccggcgagataaccgttttctcctataacaatagcttttacaccattggtaccagcgtctataccgagaaaatatttcatgacgaattccccttgaacctattgatctttttccggcttcaggcgccccagaatgcccttggccgtatattcatccgtgataagaacattaaacaacttgcttcttgcagcgccgataatcgcgtcgatcttgaatttaccccccgctgcggcgatgactgtgggaatgcttttgagcgtcgctgtgttgacggcgatgaccctctggtttaaagaggtattgcatggattgccatgcaggtcataaaagcgggcgcatatactgccgaccgccctgcttcgcctcaaatcttcgatatcgtcccgcgtaacggcatccgaatccgccgcaagcgcattttcgatcgttgaggaatggtttaaatcgccgtcgatgccgacgactgccatatccaacatttttgccttggtaaaaatagttttcagcggtttggaatccagaaaagcctgggcggtaaggacgttggttgcaatcattggggcgtataaataacgtacggtacttctgggaaaattagccgcgaccttctcgcataacgcattggaaagaatgtttacttcccggttggtaccaagcccgccgatcaggggaatgaattcgatgtccttgattttattggtggtctttactttttccgcaaaacattcaagggtcctcccccatccaaaaccgatatgaccgccgctttttagaagattggcagtatacaccgcggtggcgctgccgatccggtcgtcgatgatatcgcggttttcactgggaacatttacgatttttacatcctcaaccccgaggatgtggcgaagcgcaagttcatcttttaaaaaggcattggtttgccgcggttcggcgatctggatacggacaattttctcctgttttgcttctttgagcatttttacaatggtaggacgcgaaatattgagcattttagaaatttctgcctgtgtcttatcttccatataatataaatgtgcgatcttgactttcagatcataacgttcttcgacagaaaaagccatttttcggtctccgtttcttatgtgtaaataaaaattaattctatcatgatagtatcgaatctattaacgaatgtcaagcaaatgtaaatgtgatattcaaatgttaaccaatttcacaaaaaagtgcctaattttatcaaaaaagcaattgacttcatgaaaattttatgctttaatcaaagtatcaagcaaatgttaactttttttaatgtaattaacatttgaaaacactaattcttacaagattttcagcgaagtaaaacagaatgaaaaatatggaatttttataaatgttttcaacattagcaaaatgttgtactaattaactaaagttaactagattatcaaaattaaatgatcggggaaccatatatgaaattcgatttggtgctggatacaggctttgagatagcagagacgcccgtttgggatgaacggatcggcaaactttattatacagatctttttacaggcggtgtgcacaggtatgatccggcaaataagcaaaacgaaacatggcatacaaacgcattgatcggaagcgcggttcccacggatgatacaaattggttattctgcgcgcttgaaacggggatgcatcttctggacctgaaaacaggtaaactggaattcctgtgtgatccggaaaagggaaagccggaaaaccgttataacgatacgcgtatcgatccgcagggacgtatttttaccagttcggttgccaaactttatgggacggatgactacaggccggatatgctggggaatttctatatggtggatacggacatgagcgtgcatgtggttgaagaggggatcaaccagtataacgcgatcgtctggaactccgatgccacaaagatgttcgtgatcgatacttaccacgaggcgttgatcggttacgattacgacgctggcaaaggcccgcttggcaaaggaagggtcatgattgaattcggggaacttgggatgccggacggcatgagcatcgacagtgaagataatatctatgtctgccattggacaaagcagctttccgtttgggacaaggatatgaatctaaaggaaacggtcaatattcctgtggaatatgcgtgctgcacgggctttggcggagcggacatgcaggacctctaccttgcaaccgcaaagtattgctattcggacgaggaattaaaagcgaacaaaggagccggcggcgtgtttgttacaaggagcgcagtaaaaggagccggcgacaacttctatcgagtaaaaaggtaaaggagagtaaggaatcatgtatgcattcgaatttcaggtaccgacaaaaattgtgttcggcgaaggggaag

SEQ ID NO: 27 - DNA, 3275 bp, Christensenella sp.
ctatatttattatattgttattataataaatacttatgaacattcaatatccaaattcttacaaactccttaattctcacgaataatctttttactgctaaaataggtgatcgcgaagtatatcccgtagattacggcaataatgcccagccccatgaaaacatccgcatagacgtttacgctttcataccacatcatgttgatcatgctcatgatccccctgataccgaataccgcatgcactgccgccacggcaagcgggatcaggaaataaatagcaatttgtttcagcaaagacttattgatcatcttttcctctgtccccagcttcctgagcgttgaataacgttttttgttgtcgtttgcggcagataactgttgtagcgccagaatcacggcagccgtgactaagaacgtgattccgagatagataccgacaaaggatatcgtgacgcgcaatccaacgctggaatcctgcgatgtgagttctgtagtaaaatatgtatatggacgatccggattttcctgtttcagctcattttgaaaatcccataccgcttgttccgtcacttcctttggctggccgtcgatataaagcccgtcaatcgtgacctgctccggcttgaagtttataacgtccgcatccggataaacgaggatcacgggcgatatggacgccgctccctggatacgggtgtttgcaagtcgcatttgcccttccggaatcgtatactctttttcatttgacgttattgtttgcccgttttggataaatttttgcaggttttcatacatagactggttatatagcaccactccaagctcgttttccgaaacctcgatcggtgtttcgccgatcatggaaagcaggctattgaactgtgagacaggtacagccagggcgggcatcgtaacatcctgtgccgacgccatatcctgcatttccgctatatcaaaatagttcccgaattggctcatgacgtcaacgtcgctttcataactcgtatattccgacatttgcgaatagaatctttcaaccggaataccgtacgccttaagcgcctcaaccgctccgccgacttcctccgccgtttcgggcttcatataatactcagtgtcaaatttgatttctcgcaacgtttctttattgacagcgcccgaaacgccagatcccgccccaagcgtcgtaatcgttacgaagagcatgatgcatacaagagccatagacgtatgcgtagaattaattttactggtaagctgacgcgttacaaagagattcagtcctttaaagtaacgcttcctgttatgtgatgcgattttgtaagtaaaccctgccagccccgcaaacagtaaaaacgttccagggataccgatcagcatgacgagcggcaaatacataattaacatacctttgatgatcagataataggcgataatgatcagaatgatgcccgcaaccgtcaaagcaacggaaatgccggttttcctgctgatcgtcttttcgttttcgatgtccgcatgaagcagcttgataatcttctgctttgacacccgcgcggcattgaagatcatgacgcataggaagatcacaccgaaatagataatggattgtgtcgccgccttaggcgagaatacaaatacatactgttttaaggaaacctcgaacatatttgccgtgatgattgacatgacctgtgaaaacagtacgccgagcagtaacccaactgcaagggcgatcacaccgacgatcagcgtttcaagcataaaaatcgatgcaacacggccttttcccattccaagcatgaggtatacgcccagttccttgttcctgcgtttgatcaggaaattgtttgcgtaaagaatgagtatcgctaatgtgatcgcgacaaaggttgaaaaaatactaatgctttcgaccatcatgtgcgctgcggtcgctttgttctcgttgagttccatgaccgcttgctgtgcatctaatgagttgaaggcataaaaaaacatgaccgcgaacattagcgtaacaaaataaaccgtataatcaccaatacttttgcgcacgttgcgaaaggctaatttacacagcatcggctacgtcacctcccaaaagagaaacaacttcgataatttttccaaagaactctttgcgcgtttcatttccgcggatcaactccatgaaaattttaccgtcgcgcagaaataatatcctgctgcaatagcttgcggcaaatgcgtcgtgtgttaccatcaggagtgtcgcccgcattttttgattcatttccacaaagctttccagcatcatgcgtgacgatttcgaatcaagcgcgcctgtcggttcgtcggcaaggatcagcgacggcttcgtaatgatggcgcgtgcggctgcaatgcgttgtttctggccgccggacatctcatatggatatttgtttagtacatcgtttatctccagtgtcgccgcagcctctttgatgcgggtcttgatctgctggtatgggacattgcagatcgttaatgccagggcaatattttcatatcctgaaagcgtatcgagcaggttaaaatcctgaaaaatgaatcccagcttttcccgcctgaaatctgccaattttccggtgcttagagttgtaatatccactccgtctatcataatatgaccggttgtcaccatatcaatagttgaaatacaatttaaaagcgttgttttgccgcttcccgacggccccatgatacctaaaaattccccgtcgccaactgcaaaactgacgttatccagtgctttggtgatattccccctgctgccatagaccttttcaacgtttttcatatcaagtaatacgttcatcttttcctcctgcttactccattccaatataaaaaccagtggaacggtcaagcgtcttttcttttttgaaaaaatcttttactttgaccactaagctgtaaagtcccacaccaaccagcgccgccgcgataattccaaaaaatatgattcgtttcatttaggccattcctcctgtttttgatgattttattatatcttttcaaccgtatgattatccatcgaacttccttacaattatcttacatttttgtaagaacaaaaaaaccgactatcttatagataatcggtttttgtttttttggaggcgccacccagatttgaactggggataagggctttgcaggcccctgccttaccacttggctatggcgccatatggagcggaagacgagattcgaactcgcgacattcgccttggcaaggcgacgct

SEQ ID NO: 28 - DNA, 1277 bp, Christensenella sp.
gcacaaaaaaggacaggtcacatggcctgtccttttgtctgtctgttctgtgcttaagtcttagtcgattacgcccgatacaacgcccgatcctaccgtacgtccgccttcgcggatagcaaaacgcaatccttcttcgatcgcgatcggtgtgatcaactggatctccatctcgatgttatccccgggcattaccatctctgtaccgctcggcagctcgataatccctgttacgtccgtcgtcctgaaatagaactgcggccggtatccgttgaagaacggtgtgtgacgaccgccttcttccttcttcagtacgtatacgctgctgttgaagtgcttgtgcggatggatcgatcccggcgcgctcagtacctgtccgcgctcgatctcgttcctctgtaccccgcgcagaagcaaaccgatgttgtcccctgtgatcgcttcgtctaaaagcttgcggaacatttccactcccgttactaccacgcttctcttctcatccgtaagtcctacgatctctaccgtatcctgtactttgaccttgccgcgttctactctccccgttgctaccgtcccgcgtcccgtgatcgagaatacgtcctctacaggcatcaggaacggcttgtctacgtcgcgctccggctccggtatatagctgtctaccgcttccatcagctcgaagatgctctggcagttcgggtcgtttgcgatatcgtcagatgcctgcgccgcttccagcgccttaagtgcgctccccttgatgatcggtgtgtcgtcgcccggaaagtcgtactccgaaagaagctccctgatttccatttctaccagttccaaaagctcaggatcgtctacctggtccgtcttgttcatgtatacgatgatgtacggtacccctacctgccttgcaagaaggatgtgctccctcgtctgcggcatcggcccgtctgccgccgataccaccaggatcgctccgtccatctgcgccgctccggtgatcatgttctttacatagtccgcatgtcccgggcagtctacgtgcgcatagtggcgcgtatccgtctcatactctacgtgcgacgtgttgatcgtgattccacgctctttttcttccggcgccttgtcgatttcgtcgtattttgttgcttccgccttgcccgactttgcgagcactgtcgtgatcgctgccgtcagcgttgtttttccatggtctacgtgaccgattgttccgatgtttacatgcggtttggttctctcaaacttaccctttgccattgctt

SEQ ID NO: 29 - DNA, 20 bp, Artificial Sequence
  Synthetic primer
agagtttgatcctggctcag

SEQ ID NO: 30 - DNA, 19 bp, Artificial Sequence
  Synthetic primer
ggttaccttgttacgactt

SEQ ID NO: 31 - DNA, 19 bp, Artificial Sequence
  Synthetic primer
gtgccagcmgccgcggtaa

SEQ ID NO: 32 - DNA, 20 bp, Artificial Sequence
  Synthetic primer
ccgtcaattcmtttragttt

SEQ ID NO: 33 - DNA, 1364 bp, Christensenella sp.
atggatatattcaaatatgtggacgaagtggtcgattattacgaaacggtccaatatcgatataaaaatattgcacacgacttgaagcatatgctcgaggatatcatcgtcaagaattcggagtatacgctcaatatttcgtaccgcgtcaaggagcttgacagcgtgcgggaaaagctgattcggaacagctactacaggatgcacacgtcaaaagaggagatcgtcgccaacatccaggacattatcggtatccgcatcgagtgtaaattcaatgaagatgaacaatacgtctacaagctcatgcttaagatgttcaataaaacggacgaccagattttctattacaactcaaaatttcccaagatgcggttcaagctcaacgaaaagcagcctgtgaagcaaaaaaacggtttcgatatctacaaaatcgacgcgcgttatgaagataataagggtgaggaagacgagatccgcgtcaactttgaaatacagatcaagtccatgatcaacatgttctggggcgagatcgagcataagataatttataagaatccatcctactttatggtggagcagcaggtcattgaaaatctcgtatccatcaaggagaacctgaacctggtcgaccaccagctccatgacctatacaagcgctataagcgtgataacagctctaagctgcattaccgcaaggaaaccattgaaaacatcatttccaagctggtgcatgatacgattgcgcgcaagatgaaaaacgaccttggtttcgtggtgcagttcaaggaaagctgcgacagtatcatcgattatatctttattgtgaacaatgcggcgcaaatggaggactacggacgggttttgacggatattttctatattaccagtaatatggctggcgaggaaatggattttcgcgaatccattgaactggaacatggatttgctacgggagaccagttcatcgatacggtgggcacgaccatccagaagctgatgaacgtagactttaactggcatctttactgtatgatcctctttaagctggaacgcggcagcaacgtcgacgacttggagacgtttatccgttattacaagggaaggcttacggcaagcgcggagctttaccgtttggaagaagtattcccaggggaaaccgcgcaaaagatcaagacggacctcctaagcgagatgggatatgtattccgccgtcacgcggacattacgctcttgtatagcggtgggatcaaggagttgacccgtgcgcttaagaaaacagtggaaaacatcatcaaggacaagcccgactggaacaaagagaaatccatttacctgctgtatctaaacaacagcgtaagtctcga

SEQ ID NO: 34 - DNA, 1377 bp, Christensenella sp.
atggatattttcaagtatgtggacgaagtggtcgattattacgagaccatacaatataaatataaaaatattgcgcatgacctgaagcacatgatggaagaagcggtatgtaaaaattcagaatatacgctgaatatctcttaccgggtaaaggagccggagagcgtgcgggaaaagctgatacgcaacagctactaccgcctgcatacgacaaaagaggagatcgtcgccaatatacaggatatcatcggcctgcgcatcgagtgcaaattcaacgacgacgaggcctacgtctattcgcttatgctcaagctgttcaaccggacggacgaccaaattttttattataacgataagttccccaaaatgcgcttcaagctgaacgaaaaacagccggcgaaacagaaaaacggcttcgatatttataaaatagacgcgcgctatgaagaccataagggagaagaggacgagatacgcgtcaactttgaagtgcagatcaaatcgatggtcaacatgttctggggcgatatcgagcataagatcatctataaaaatccttcctacttcatggtagaacagcaggtcattgagaacatggtttctatcaaggagaacctgaaccttgtcgatcatcagctccatgtgctgtataagcggtataagcgcgataacaactccaagctgcattaccgcaaggagaatatccagaatatcatcagcaagctgatccacgataccatcgcgcgtaagatgaaaaacgacctcggcttcgtcgtgcagttcaaggacagctgcgacagcatcgtcgattacattttcatcgtgaacaacgcggcgcagatggaggattacgggcgcgttatgacggagatgttttatatcacaggaacgatgagcggcgaagagctcaatttccgcgaatcgcttcagctcgagcgtgaattcaatacaggcgatccgtttatcgatacggtagggacgacgatccaaaagctgatgaacgtggatttcaactggcatctttactgtatgatcctgttcgaactggagcgcggcagccggatcgacgcgctcgagacgtttatccgatactataaggggagactgacggcgaattcggagctgcaccgcctcggggaagtattcccgtcggaaacggcgaagaagatcaaggcggatctgctctcggaaatgggctatgtgttccgccgtcacgcggatatcaccctgctgcacgaagaggggattctcgaaatgacacgcgccctgaaaaaaacggtatccaatatcatcaaggacaatccggactggaataaagagaaatccatctattttctgtatctgaacaacagtgtcaatctggaaacgcgaaattga

SEQ ID NO: 35 - DNA, 1377 bp, Christensenella sp.
atggatatttttaaatatgtggacggagtggtcggttattacgagaccatccaatacaagtacaagaatattgcgcacgacttaaagcacatgatggaggaagtcgtgtgtaaaaattcggaatatacgctgaacgtttcctaccgcgtgaaagagccggaaagcgtgcgtgaaaaactgatccgcaacagctattaccggctgcacaccacaaaagaggagatcgtcgccaatatccaggatatcatcggcctgcgcgtcgaatgcaaattcaacgacgacgaggcctatgtttattcgctgatgctcaagcttttcaacaagacggacgaccagattttttattacaatgaaaaattccccaagatgcgcttcaagctgaatgaaaagcagcccgccaagcagaaaaatggctttgacatctataagatcgacgcacgctatgaagaccacaagggagaggaagaagaaatccgcgtcaatttcgaggtgcagatcaagtctatggtcaacatgttctggggcgatatcgagcataagatcatctacaaaaacccatcttattttatggtggagcagcaggtgatcgagaacatggtgtcaattaaggaaaacctgaacctcgtcgaccaccagctgcatgtgctctataagcgttataaacgcgacaacagctccaagctgcattaccgcaaggagaatatccagaacatcatcagcaagctgatccacgataccatagcgcggaagatgaaaaacgacctcggctttgtcgtacagttcaaggacagctgcgacagcatcgtggattacatctttatcgtcaataacgctgcgcagatggaggattacgggcgcgtcatgacggaaatgttctatatcacggggacgatgagcggcgaggaattgagttttcgcgaatcgcttcagctggagcatcagtttaatacgggcgatcccttcatcgatacggtgggcacgacgatccagaagctgatgaacgttgatttcaattggcacctttactgcatgattttgttcgagctcgagcgcggcagcaaaatcgatgcgctcgagacgtttatccgctattataaaggccgcctgacggcaaattcgcagctgcaccgcctcgaagaggtgttcccggcggaaacggcaaagaagatcaaagcggacctgctctgcgaaatgggttatgtgttccgccgccatgcggacatcacgctgctgcacgaggagggaatcatagaaatgacgcgcgcacttaaaaagacggtggccaacatcatcaaggacaatccggactggaacaaggaaaaatccatctatttcctgtatctcaacaacagcgtcaacctggaaacgcgaaattga

SEQ ID NO: 36 - DNA, 1377 bp, Christensenella sp.
atggatattttcaaatacgtggacgaggtagtggattattacgagaccgtccagtaccgatacaaaaatattgcgcacgacctaaagcatatgctggaagacgtgatcgtcaagaattcggagtatacgctcaatatttcgtaccgcgtcaaggagctggacagcgtgcgcgaaaagctgatccgcaacagttattaccgcatgcatacctcaaaagaggaagtcgtcgcgaatatacaggatatcatcggcatccgtatcgagtgtaaattcaatgaggacgagcaatatgtttataagctgatgctccagatgttcagcaaaacggacgaccagatctttttttacaattccaagttccccaaaatgcgctttaagctgaatgaaaagcagccggtcaagcaaaagaacggctttgatatttataagatcgacgcgcgctatgaggacaacaaggggcaggaagacgagatccgtgtgaatttcgagatacagatcaagtccatgatcaacatgttctggggcgagatcgagcaccggattatctataagaacccgtcatactttatggtggagcagcaggtgattgaaaacctggtttccatcaaggaaaacctgaacctggtcgaccaccagctgcacgacttatataagaggtacaaacgcgacaacagctccaaactgcattaccgcaaggaaaccatcgaaaacatcgtttctaagctggtacacgatacgatcgcgcgcaagatgaaaaatgacttgggttttgtggtgcagttcaaggaaagctgcgacagtatcatcgactatctctttattgtgaacaacgcggcgcagatggaagattacggccggatattgacggacattttctacatcaccagcaacatgaccggggaagagatggatttccgcgaatcgttggaattggagcacggattcaatacgggagaccagttcatcgatacggtggggatcaccatccagaagctgatgaatgtggatttcaactggcacctctactgcatgatcctgtttgaactggaacgcggcagcaacatcgacgacctggagacatttatccgttattacaaggggaggctgaccgccaacgcggagctttaccgtttggaggaagtgttcccggcggagaccgcgcagaagatcaagacggacctgatcaacgagatgggatatgtgttccgccgccatgcggatatcgcgctgttatacagcgggggcatcaaagagctgacgcgggcccttaaaaagacggtggagaacatcatcaaggacaagcccgactggaacaaggaaaaatccatttacctcctatacctcaacaacagcgtgagcgtagaggagatcaattga

SEQ ID NO: 37 - DNA, 849 bp, Christensenella sp.
atggcaagtaatctagatatagacaggaaggatacgctcatcccggacatcggcgtcatcacggacatcaggaaggatacgccggacgtcaagacgttccgcgcgcaggggaggagcggcggcgtatgctttgcgcatatgccggggcagtgcgcgatgctttccattcccggcgtgggggaggcgatgttttccattacctcgtcgcccacaaacacggaattcatggaattcagcatcaaaaagtgcggctgcctgacggactggctgcaccagatggacgtcggacagcagatcacgatccgcgggccgtacggcaatgcgtttccggtagaaacggaacttgtgggcaaagacctgctcttcatcgcaggcggcatcggccttgccccgcttcgttcggtgatcaattacgtgctgcactaccgtgagaagtatggcaagatcgacatcgtctatgggtcgcgctccatggaagacctggtggatttcaatgaaattaaaaacgagtggagcaatgcaaaggatgtgcaagtacacctgacgatcgaccaggaggaaggcaagtgggacggacatgtcggttttgttccaaactatgtcaaggagcttggctttcagacggacaggacggcgctcgtgtgcgggccgcccatcatgatcaagttcacgctgcaggccttagaagagctggggttcgataaaaagcaggtatatacgacgatggagctgcgcatgaagtgcggcgtgggcaaatgcggacgctgcaacatcggttccaaatatgtgtgcaaagacggcccggtattccgttgcgacgagctttcggaactgccggatgaatattga

SEQ ID NO: 38 - DNA, 834 bp, Christensenella sp.
atgagtatgagacaggacacattgatcccaaagatcggggtcattacggatatcagaaaggatacgccggacgtaaaaacgttccgcgcagtggcgccggagggcggcgttgtctttcagcacatgcccggacagtgcgcgatgctttccattccgggggtgggagaggcgatgttttccatcacttcctcgcctaccaatacggaatatatggaattcagcatcaaaaaatgcggttgtctgacagactggctgcaccagatggacgtagggcagcagatcacgatacgcgggccgtatggcaatgcgtttccggtggaaacggagctcaagggaaaggatctgctgttcattgcgggggggatcggccttgcgccgcttcggtcggtcatcaattatgtacggcattaccgtgaaaattatgggaagatagatatcgtttacggctcgcgctccaaagacgatttagtggatttcgacgaaatcagaaacgagtgggcgaacacggaaggcgtgaacgtatatcttacgatcgacagggagcaggaaggctgggacgggcacgtcggctttgttccgaattatgtgaaggagctcggcttttctacggataaaacggcgctcgtatgcggaccgccgatcatgatcaaattcgttctgggcgcgctttcagagctcggttttgataaaaagcaggtctatacgacgatggagctgcgaatgaaatgcggagtcggtaaatgcggacgctgcaacatcggctccaaatatgtatgcaaggacggcccggttttccgctgtgacgagcttgaagagctgccggacgaatactga

SEQ ID NO: 39 - DNA, 834 bp, Christensenella sp.
atgaatatgagacacgatacgctgatcccgcaaatcggggtcattacggatatcaggaaggacacgccggacgtaaaaacattccgtgcggtgtcacccggggggggcgtggttttcaagcatatgcccggccagtgcgccatgctttccatcccgggggtaggagaagcgatgttttccatcacttcgtcgccgacgaatacggaatttatggaattcagcattaaaaagtgcggctgccttacggactggctgcaccagatggatgttgggcagcagattacgattcgcggaccgtacggcaatgcgttcccggtggaaacggagcttcgcggcaaggacctgctgtttattgccggcggcatcggcctcgcgccgctgcgctcggtaatcaactatgtgctgcattaccgtgaaaattatgggaaggtcgatatcgtctatggttcgcgctccaaggaagatcttgtggatttcgatgaaatcaaaaacgaatggtcgaatgcggaaaatgtgaacgtatatcttacgattgaccgcgaacaggaaggctgggacggtcatgtgggctttgtgcctacttatgtgaaagaactcggcttttctacggataaaacggcgctcgtatgcggaccgccgatcatgataaaattcgttctgggcgcgctttctgagctcggtttcgataagacgcaggtttatacgacaatggagctgcggatgaaatgcggagtcggcaagtgcggacgctgcaacatcggttccaaatacgtgtgcaaggacggaccggtttttcgctgcgacgagcttgaagaactgccggacgagtactga

SEQ ID NO: 40 - DNA, 849 bp, Christensenella sp.; identical to SEQ ID NO: 37

SEQ ID NO: 41 - DNA, 1424 bp, Christensenella sp.
tttcggttaagccactggcttcgggtgctcccaacttccgtggtgtgacgggcggtgtgtacaaggcccgggaacgcattcaccgcgacatgctgattcgcgattactagcaactccgacttcatgtgggcgggttgcagcccacaatccgaactgggaccggctttttgagattcgcttacccttacggggtcgctgccctttgtaccggccattgtagcacgtgtgtagcccaagacataaggggcatgatgatttgacgtcgtccccaccttcctccgagttgtccccggcggtctcactagagttcccatctttacatgctggcaactagcaataagggttgcgctcgttgcgggacttaacccaacatctcacgacacgagctgacgacaaccatgcaccacctgtctctctgccccgaagggaacatgtatctctacatgcgtcagaggatgtcaagccttggtaaggttcttcgcgttgcttcgaattaaaccacatgctccgctgcttgtgcgggcccccgtcaattcctttgagtttcaaccttgcgatcgtactccccaggcgggatacttaatgcgtttgcttcggcacggaaccctatcgggccccacacctagtatccatcgtttacggcgtggactaccagggtatctaatcctgtttgctccccacgctttcgtgcctcagtgtcagttacagtccagaaagtcgccttcgccactggtgttcctcctaatatctacgcatttcaccgctacactaggaattccacttccctctcctgtactcaagtcacacagtttcaaatgcaaccccggggttaagccccggtctttcacatctgacttacatgaccacctacgcaccctttacgcccagtaattccggacaacgcttgctccctacgtattaccgcggctgctggcacgtagttagccggagcttcctcctatggtaccgtcatttgtttcgtcccataggacaaaggtttacaatccgaagaccttcttccctcacgcggcgttgctgggtcaggctttcgcccattgcccaatattccccactgctgcctcccgtaggagtctggaccgtgtctcagttccagtgtggccgttcaccctctcaggtcggctacccatcgttgacttggtgggccgttacctcaccaactatctaatgggacgcgagcccatcctgcatcgaataaatccttttacctcagttccatgcgaaaccgtggtctcatgcggtattagcagtcgtttccaactgttgtcccccgttgcagggcaggttgctcacgcgttactcacccgtccgccactaagtatactcacagttccacccgaaggcttcacaaagagcaacttcgttcgacttgcatgtgttaagcacgccgccagcgttcgtcctga

SEQ ID NO: 42 - DNA, 1432 bp, Christensenella sp.
ctctctcctttcggttaagccactggcttcgggtgctcccaacttccgtggtgtgacgggcggtgtgtacaaggcccgggaacgcattcaccgcgacatgctgattcgcgattactagcaactccgacttcatgtgggcgggttgcagcccacaatccgaactgggaccggctttttgagattcgcttacccttacggggtcgctgccctttgtaccggccattgtagcacgtgtgtagcccaagacataaggggcatgatgatttgacgtcgtccccaccttcctccgagttgtccccggcggtctcactagagttcccatctttacatgctggcaactagcaataagggttgcgctcgttgcgggacttaacccaacatctcacgacacgagctgacgacaaccatgcaccacctgtctctctgccccgaagggaacatgtatctctacatgcgtcagaggatgtcaagccttggtaaggttcttcgcgttgcttcgaattaaaccacatgctccgctgcttgtgcgggcccccgtcaattcctttgagtttcaaccttgcgatcgtactccccaggcgggatacttaatgcgtttgcttcggcacggaaccctatcgggccccacacctagtatccatcgtttacggcgtggactaccagggtatctaatcctgtttgctccccacgctttcgtgcctcagtgtcagttacagtccagaaagtcgccttcgccactggtgttcctcctaatatctacgcatttcaccgctacactaggaattccacttccctctcctgtactcaagtcacacagtttcaaatgcaaccccggggttaagccccggtctttcacatctgacttacatgaccacctacgcaccctttacgcccagtaattccggacaacgcttgctccctacgtattaccgcggctgctggcacgtagttagccggagcttcctcctatggtaccgtcatttgtttcgtcccataggacaaaggtttacaatccgaagaccttcttccctcacgcggcgttgctgggtcaggctttcgcccattgcccaatattccccactgctgcctcccgtaggagtctggaccgtgtctcagttccagtgtggccgttcaccctctcaggtcggctacccatcgttgacttggtgggccgttacctcaccaactatctaatgggacgcgagcccatcctgcatcgaataaatccttttacctcagttccatgcgaaaccgtggtctcatgcggtattagcagtcgtttccaactgttgtcccccgttgcagggcaggttgctcacgcgttactcacccgtccgccactaagtatactcacagttccacccgaaggcttcacaaagagcaacttcgttcgacttgcatgtgttaagcacgccgccagcgttcgtcctga

SEQ ID NO: 43 - DNA, 1431 bp, Christensenella sp.
tctctcctttcggttaagccactggcttcgggtgctcccaacttccgtggtgtgacgggcggtgtgtacaaggcccgggaacgcattcaccgcgacatgctgattcgcgattactagcaactccgacttcatgtgggcgggttgcagcccacaatccgaactgggaccggctttttgagattcgcttacccttacggggtcgctgccctttgtaccggccattgtagcacgtgtgtagcccaagacataaggggcatgatgatttgacgtcgtccccaccttcctccgagttgtccccggcggtctcactagagttcccatctttacatgctggcaactagcaataagggttgcgctcgttgcgggacttaacccaacatctcacgacacgagctgacgacaaccatgcaccacctgtctctctgccccgaagggaacatgtatctctacatgcgtcagaggatgtcaagccttggtaaggttcttcgcgttgcttcgaattaaaccacatgctccgctgcttgtgcgggcccccgtcaattcctttgagtttcaaccttgcgatcgtactccccaggcgggatacttaatgcgtttgcttcggcacggaaccctatcgggccccacacctagtatccatcgtttacggcgtggactaccagggtatctaatcctgtttgctccccacgctttcgtgcctcagtgtcagttacagtccagaaagtcgccttcgccactggtgttcctcctaatatctacgcatttcaccgctacactaggaattccacttccctctcctgtactcaagtcacacagtttcaaatgcaaccccggggttaagccccggtctttcacatctgacttacatgaccacctacgcaccctttacgcccagtaattccggacaacgcttgctccctacgtattaccgcggctgctggcacgtagttagccggagcttcctcctatggtaccgtcatttgtttcgtcccataggacaaaggtttacaatccgaagaccttcttccctcacgcggcgttgctgggtcaggctttcgcccattgcccaatattccccactgctgcctcccgtaggagtctggaccgtgtctcagttccagtgtggccgttcaccctctcaggtcggctacccatcgttgacttggtgggccgttacctcaccaactatctaatgggacgcgagcccatcctgcatcgaataaatccttttacctcagttccatgcgaaaccgtggtctcatgcggtattagcagtcgtttccaactgttgtcccccgttgcagggcaggttgctcacgcgttactcacccgtccgccactaagtatactcacagttccacccgaaggcttcacaaagagcaacttcgttcgacttgcatgtgttaagcacgccgccagcgttcgtcctga

SEQ ID NO: 44 - DNA, 1429 bp, Christensenella sp.
tctcctttcggttaagccactggcttcgggtgctcccaacttccgtggtgtgacgggcggtgtgtacaaggcccgggaacgcattcaccgcgacatgctgattcgcgattactagcaactccgacttcatgtgggcgggttgcagcccacaatccgaactgggaccggctttttgagattcgcttacccttacggggtcgctgccctttgtaccggccattgtagcacgtgtgtagcccaagacataaggggcatgatgatttgacgtcgtccccaccttcctccgagttgtccccggcggtctcactagagttcccatctttacatgctggcaactagcaataagggttgcgctcgttgcgggacttaacccaacatctcacgacacgagctgacgacaaccatgcaccacctgtctctctgccccgaagggaacatgtatctctacatgcgtcagaggatgtcaagccttggtaaggttcttcgcgttgcttcgaattaaaccacatgctccgctgcttgtgcgggcccccgtcaattcctttgagtttcaaccttgcgatcgtactccccaggcgggatacttaatgcgtttgcttcggcacggaaccctatcgggccccacacctagtatccatcgtttacggcgtggactaccagggtatctaatcctgtttgctccccacgctttcgtgcctcagtgtcagttacagtccagaaagtcgccttcgccactggtgttcctcctaatatctacgcatttcaccgctacactaggaattccacttccctctcctgtactcaagtcacacagtttcaaatgcaaccccggggttaagccccggtctttcacatctgacttacatgaccacctacgcaccctttacgcccagtaattccggacaacgcttgctccctacgtattaccgcggctgctggcacgtagttagccggagcttcctcctatggtaccgtcatttgtttcgtcccataggacaaaggtttacaatccgaagaccttcttccctcacgcggcgttgctgggtcaggctttcgcccattgcccaatattccccactgctgcctcccgtaggagtctggaccgtgtctcagttccagtgtggccgttcaccctctcaggtcggctacccatcgttgacttggtgggccgttacctcaccaactatctaatgggacgcgagcccatcctgcatcgaataaatccttttacctcagttccatgcgaaaccgtggtctcatgcggtattagcagtcgtttccaactgttgtcccccgttgcagggcaggttgctcacgcgttactcacccgtccgccactaagtatactcacagttccacccgaaggcttcacaaagagcaacttcgttcgacttgcatgtgttaagcacgccgccagcgttcgtcctga

SEQ ID NO: 45 - DNA, 1471 bp, Anaerostipes sp.
  misc_feature (1435)..(1437): n is a, c, g, or t
  misc_feature (1441)..(1441): n is a, c, g, or t
  misc_feature (1452)..(1453): n is a, c, g, or t
  misc_feature (1461)..(1463): n is a, c, g, or t
  misc_feature (1465)..(1465): n is a, c, g, or t
gctccctccttgcggttgggtcactgacttcgggcgttactgactcccatggtgtgacgggcggtgtgtacaagacccgggaacgtattcaccgtgacattctgattcacgattactagcgattccagcttcatgtagtcgagttgcagactacaatccgaactgagacgttatttctgggatttgcttcgcctcacgacttcgcttccctttgtttacgccattgtagcacgtgtgtagccctggccataaggggcatgatgatttgacgtcgtccccaccttcctccaggttatccctggcagtctctctagagtgcccatccgtaatgctggctactaaagataggggttgcgctcgttgcgggacttaacccaacatctcacgacacgagctgacgacaaccatgcaccacctgtctccaatgtctcgaaagaaaaaaccggttaaggttcggtcattgggatgtcaagaccaggtaaggttcttcgcgttgcttcgaattaaaccacatgctccaccgcttgtgcgggtccccgtcaattcctttgagtttcattcttgcgaacgtactccccaggtggaatacttactgcgtttgctgcggcaccgaagcctctacggccccgacacctagtattcatcgtttacggcgtggactaccagggtatctaatcctgtttgctccccacgctttcgtgcatcagtgtcagtgacagtccagtaagccgccttcgccactggtgttcctcctaatatctacgcatttcaccgctacactaggaattccgcttacctctcctgcactccagcatgacagtttcaaaagcagtcccggggttaagccccgggctttcacttctgacttaccatgccacctacgcaccctttacacccagtaattccggataacgcttgccccctacgtattaccgcggctgctggcacgtagttagccggggcttcttagtcaggtaccgtctgttttcttccctgctgatagagctttacataccgaaatacttcttcactcacgcggcgtcgctgcatcagggtttcccccattgtgcaatattccccactgctgcctcccgtaggagtttgggccgtgtctcagtcccaatgtggccgttcactctctcaagccggctactgatcgtcgccttggtgagccgttacctcaccaaccagctaatcagacgcgggaccatcctatactgccagggcttttcacactgaatcatgcgattctgtgcgcttatgcggtattagcagccgtttccagctgttatccccctgtatagggcaggttccccacgcgttactcacccgtccgccactcagtcatataggaaatccatccgaaaacttcaatcctaaatgcttcgttcgacttgcatgtgttaagcacgccgccagcgttcatctgagcagnnncaanaaattctaaannaaaaaaannnanactcac
